United States Patent 9,567,581 (SELECTIVE REACTIVATION OF GENES ON THE INACTIVE X CHROMOSOME) - sequence listing, part 11

SEQ ID NO: 1041 - DNA, 4990667 bp, mus musculus (residues 1,663,557-3,327,112 of 4,990,667)
  misc_feature (1341778)..(1391777): n is a, c, g, or t
  misc_feature (4586815)..(4636814): n is a, c, g, or t
  misc_feature (4712453)..(4762452): n is a, c, g, or t
caagagaatcctaagcaaaaagaacgaagctggaggcatcatactacttgacttcgaactatactacaaggctacagtaaccaaaacagcatggtactggtaccaaaacagagatatagaccaatggaacaaaacagagcgctcagaaataacaccacacatctacaaccatctgatctttaacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccagaagcaatggcaacaaaagccaaaataaacaaatgggatgtaattaaactaaagagtttctgcacatcaaaagaaactaccatcatagtgaacaggcaacctacaggatgggagaaaatgtttgcaatctacccatctgacaaagggctaatatccagaatctacaaagaacttaaacaaatttacaagaaaaacacaaacaaccccatcaaaaagtgggcaaaggatatgaacagacacttctcataagaagacatttatgcagccaacagacacacgaaaaaatgctgatcatcactggccatcagagaaatgcaaatcaaaaccacaatgagataccatctcacactagttagaatggcgatctttaaaaagtcaggaaacaacagatactggagaggatgtggagaaataggaacacttttacactgttggtgggagtgtaaattagttcaaccattgtggaagacagtgtggccattcctcaaggatctagaactagaaataccatttgacccagcaatcccattactgggtatatatacccaaaggattataaatcatgctactataaagactcatgcacacatatgtttattgtggcactattcacaatagcaaaggcttggaaccaacccaaatgtccaacactgatagactggattaagaaaatgtggcacatatacaccatggaatactatgcagccatgaaaaatgatgagttcatgtcctttgtaggggcatggatgaagctggaaactatcattctcagcaaactatcacaaggacagataaccaaacaccacatgttctcactcataggtaggaactgaacaataagaacacttggacacagggcggggaacatcacacactggggcctggggggtgggggcctgggggagggatagcattaggagatatacctaatgtaaatgacgagttgatgggtgcagcaaaccaagatggcacatgtatacctatgtaacaaacctgcatgttgtgcacatgtaccctagaacttaaagtataataataattaaaaaaaaaaaaagagagatgtgaccttgtagccactggcctcactaatcctaatctgagtattttctttcccatatcacatcttgaaagggaggccttacgtttgctcctagaggactcctgctttgctgtattttttctaagaaacacatccataatgaaggtgtgtgccgcctcatgtgaagcgagaagagagaagcgagttagcccaacctcctccttcctgctggggaacatttcctggagggaaaaggagagaacattctgtctcaaactagggagagagatgagagcgtcccgtccttctagaaagaagtgtgacatctttgtaaaggggaaaggttgtcggagccccacccttgcacaaggtccagtgcaggaagctagaatgtggccactgagagctcatcccttcagtccatgggcagacaatgccaggcaaactgcccttccccaaacacctcagtagagtttggctatccaaggaatgccaagtaatgtttcttagaactttctttggaatcctgaaatgggggcctaagccttggattataaaagaggattcccctatttcccatcacctcatgcctcatgcttggcctcctctgcaggactgggccagatgatcagatgcaaagagaaggattcacctgaggcggcacacaccttcattatggacatatttcttagagaaaatacagcaaagcaggagccctgtaggaacaacaataaagcctccctttcagaattcaaagatgtgatatgggaaagaaaatacccagattaggattagtgaggccaatagcttggaggtcatttctctttagaggtgtcactttagccttgattatgctggggcaacccagcttgaccttgtccttccacggacctgcggtgtccatgtttccaccagttgtttgtttctctatttacttttaggacaaaaaaagtcgccagcttttattttgtggtagacctctcagaaacccagcagcatgcctgtgagcttagcttacgctgttcctctgcatggaataccttctctctcctctccacggtgagtgcctcctcttccttcaaggcctagctgaactgccccctctgtgaaacttcctccccctccccagggaaggtgagtcgcttccacagcacctgtttctgctctcatcctcacactcagcaccctgtaggacaccacgagcccctggaggcccagcagacagcctggaatggaagatgggtttgagtgaattatcgtgctgccgctggccatgaggccttatctgtaaaacagcgtccttcttccctacctcagagctactgtgaggctcaaacaaacccccagggttaaagcgggagctgtaacttgtaaaagaacccccaggtgtcacctcatgcattgatttcctcattcacaagttatcaaatgccagccactaccaggcagaagctgacaaagacacactgccaaccttcaaggagcccgccatctagggtgggagacaggagcaagcaaagagtcacagaagtgcgtttccactctgatgagggcaagcccagagcaccaatgcaggctgctggctcagggaagcctgccccaactaggagatccctaagctgacttcaaaaggccccagaagagtgagtaaaacagagcgcatggtgtcctgaaagacattccatggccagggtgggaaggacaaagtgatggcacagagccagcatgttcttataacagtgacaagctgtgtcacagcaagtgtgaagcaagatcgggagcaaagttgagaacatgtgggggctgtgtgccaagctagggagttacaaggggggaaagatggtggagcccctagaagttggaagcaggagtgagtgttgcgactggaaagatcaccttggctgcagtgcagggaagagattttggacaagtctaaggctccaggcatggtgggcgggggggaatgacaagagcaaatcagagacaagaactacatttgactcttgaacaatgtgggggttaggggcacggagccccgaagtcaaaaatccacatataacttttgactcacctaaaacttcactaatatagcttactgttggctggaagccttaccaataatgtaaacagttgatgaacaaatattttgtacattacatgtattacatactgtgtcccagcaataaattaagctagagaaaagaaaatgttactatgaaatcataaggaagagaaaatatatttactattcactgagtgaaagtggatcatcatggtctccatcctcacggtcttcctgatgagtatgctgagaaggaagatgaggaggagctgatcctgctgctcagcggtgggagagatgagaaaaaaatctgcctgtaaatggactcacaaggttcaaacccatgttgttcaggggtcaactgtaatactgcctgaagacctgctcaacatcaggccactttacatataagtagttcatcccattgagatgcaaaagtatcccatcaggtagacagtactggtctcactcaacaaatgagaaacaggctcagagaggttaagcgacttgcccaaggtcacacagcctgcacacagcctgcgcagaacttgtgtttttcccttgtactctgtcaggcttccgatctgcaggttgacggactgggaagcaaggtatggagggacattaagctagaagggttaccaggggcaaaactgggcagagggatcacaggccaggctaaggagccctttacggttcaggctctgaaggtttaagagcagggagatgccctgaccagggccgttcactacgaagattaacctggtagagcagggaggactagctaggtgagagctgggaaacaggggagctactcatcagttgtctaatatgtgcccctctctgttctaggtcctggagtaccagtagtgaatacaacaaagatgcctgccctcagacagcctgccttctagtggagggacaacaaagagcaaaacaaacaagcaaaatatacagtaggtcagaaggggataagaactgttggaaaaaaaagtagagcaaggtgagtggcttgtttgtactgggggctgcaatacttaaatagggtgcctaagaggaggcaggcggagaggacaactgagacaaagatgagaggcaggagtgtggctggcacatgaggttcaaccacaaagccagtgttctggggctggagtgagccagacgagagaagagttgtggagcgatggaaggggacacgtcgtgccaagctttggagatcacagtgagaactctggctcgtactacttggggggatgatgatgacccaaaagtcaggaatctgttcactgctgaagagagaagagggcaaagggcagcagctccatttaaaaggttctaataagcctcgggcctttctctgtctgagaaacttactctctgccctctgtctccctagattactgcccctatgcctggaggaaaaacaggtgaaggctaaaagccacggggatagctaaagagggcaaactggacctccagctccacttctgcaggtctatgtcagtccacagcccttgcacacgctcccttttaattctccaagcatacctctcacttccaaaactcctgtgactctgctgatgagggcgtctcggcctggaatgctcctccttatctgcattgtgtgggtgtcaaaaagagtatattttgatgacctctccccgcccctcatgctcgctcacatccccctcactcctttcaaagtccgttcccaaaggccccagttcaccgtcctgggctgcttttagccaggtaagatctaaagtgatcctctcttggaacctggtctggggcctatacatctgggtcagtctaggggtgctctcgaagggccaccctcaaagagcgagcctcggctggattcagttcctaggtcccagccgtccgacctctgcgacaacactcagcacaccccttcccctctccgggtctcagttgccccgtgagtacagtccctgctccaacacgcaaggtaatcgtttctggctgctctgatgcactcggtccctaaactcagccttaggtcaacccagaaagcacccgacccgggcgaccccgtagctccccaccctcccgcactgcccagtcgctgacacagggtgacctccaatggcaaggccacgactcttacccgtccgtaggcgcccccctgtctggcctcagctcgcaagcaggctgcacccactgaactccaggcccggaccgccaccctttactcccctcccgcgtgagccgagaatcagccgagcttcctccaccaagaggattggcccagctcggcgacgactcagccaattggcgctcacggcgtgatcttgcccaataaagacggggctctgtcgccagcgtgcccctccccgcgctgggccggggctttgccaggttagtcccaccctcttcggccctgcaccaatagggagaggcggcgacgagcggacggccaatggggagcggggctgcgcgcgcggggcggtgggaacggcgccgagtcagtgtacacgtcggttgcctaacaaccggcagcggactcctttggctatggtgagtgctgccgctctgtcgcgccccacgcccagcggctgagcccttcccaggccccagctcggccacgccgcctctcctgcgcctttctcggctttagcgcaccagtctttcctttgagctctttcccgggagagtagggtacagacgctaaccaacctactgggcctgcgcttcgctgctgcctcctcttcacccacaacaggcccacacccgcccctcgggctccccttgcattccctgatcccctcggtgaacctccctgggcaaaaaagactcgaatccctcacaggcccctgactctctcagaccttggccccctggcctcctcattctgccaaaatttccacacacagctgggaaaaggtgtatcgtgttctgttacaatgttttttacaatttaaatacaggggcattcaggggatgctttagcttcttggagaaggcacgaaggtgccagatggattgagttttattactcggtactgacacaatatacatcttaacaacttactaatatttggccaaatctagaagtaattgggaagtcggagtacttactgggaaggggagtactgggagtgggcatcgtaagactgttttcagaaccaggatccccacgttcgggaagagctgattatctctagttattcacagtcatcttcttgactggctctcttttgggatgattttcagtaagaggtgtccttactgaacaagtgatctccctgcttctagaaacaacagtaaagaaaagggaggggtagaagttcatggaaagattcattgttcttgccagtaaaccctgttatctttctttttaagcaaagctttggaattggttatataaatgactttaaaaatacatatgggtgtctgtaactatgttatgtaaatatggactgtatgatatattattgtgcttgtgtattgcataacatataaaggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggcaagctctgtgcattcctgccgtactgcccttcctttcctctgcctcttccttgtcatctccctatcacctctctaccccttttgccctcttctccctgcagtaagtaacaggggaggttgtactgtgctgttttcctgtctttacttactttgagtattattcaataaaattgattgcaaatatcaattagatcaatgtcatagtgttccccaatcatattaacatgaccacatcagatgctggcttaatgctctcaacactgttatttttgctcctgctactttagatgtgcttattgagacgatcctgttttctttataggtggcaatgagggccctgggctttgaacccaagaaagaagaaattaagaaaatgataagtgaaattgataaggaagggacaggaaaaatgaactttggtgactttttaactgtgatgacccagaaaatggtaagtagctaagacaattatcatggtatggagccccagtcatctgcagaggtccatggcgtcttcctgttaaaacagtcatgtgaccacagagcagtccaggtagcaactgcatcaggaggcctgccctcccatcatgttactttgggctcccaaaacaagcccttgtgcttctttctcaagacttccaagcagatacctcttcccacagaattccaaatcagttaggaaatagatatgggatagggagagatatagcgataggtagcaaacgtcaccttggatggagtgcctggcttgcctggtgtttctttgaggccaaaatgggcttcctgacacttgccgcaagtctagactcgagttacattgttaaaaaggaaagggtgacctgaccaggcagtggcagggctacaggacagtagtaaccaaccgtggtgtccccctactcatgtgttttatgttctacttgttaagtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggtttgtaatgcatcacactggaacttaaaattcccacctttgagccctctgtgacttttccattacattttccctagtgtgagcacctctttgaagaaaagccagtgtactttgtccctctgcagacaacttaattctcctttaatagtcagacaaacctatgaaccctgcttccagaaaaatgcacatatgcacaattttgcttactattttaggttccaggaatccctctagtcaaggcaatcttcaaggtccctcccaggtgatatgtttgacaaagtatgagttggttttcaaataacttttcagaaaccaagctattatcaggagtagcatactggcattgggtggactacaatgatctattcacatagatacaaattatctattcacatagattaaaagtctattgcttgccaggcacagtggatcatgcatataatcccagtactttgggaggctgaggcaggaggatctcttgtggccaggaatttgagaccagtgtgggcagcatagagaccccatctctaaaaaaaaaaaagtctattacttagtcaccttttggcattagtttataaattaacctgaatctttactgtcatataggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctctaaggatgagttctttagctttgcttatgagttcctcttctcaattattgtgttgaaggcagcctattagatacaaaactccttaccagcctatggacagaaaatgaataatcctttgctactttcctggcatgaattgctttttgccttggaaggctgctggtttgtaaaactagcagaatttttatatcacctaagcctaaatgatgctctaaaaatagttttggcaaagctaagactggaaaagagtcttgttagtaatttgtgcttgaataaaatggggagagccaggctaacgcaacactaggatggattcagccaacctctcgtgaatttatttgcttatggtatctcatcgactcttggaggtgggttgggctgagtgaccccatccaaccatcttcctggccttgcccgggattccctgtgtgagaaatcctggtagatgacattaaagtctctgctccagggtgagagtggggaggcagaaggggtgagggagaatagaaaatgaacaatgatggaatgctcgtttgttcacatggagagggagaaaacagattttcaaacttctgggggtaggctagtcctctggggatagggttgcctgattcagctaataaaaagaaagttgaggtaaatttgcatttcagatcaatgatgccttttttttagtatgactatatcccatttgtattttttgtttattcattgttgatcttaaatgcaaatttacctaagcatcctgtattgccactggtaaccctacccggggagcacgttacagaggccagaagcctggccctcggtctcatgcctctggaccctgacatcctgtaggacttgggggcccaggaatatgaagtttaccatatcccccagatgagtctcatgccgagggactgctccttaagaaaaacttgggggaagagcccagactagcccaaaccctggattctcacacacacccacttcctcatcgggcaatttggggcaagctacttctctaggtgcctggagtttgatgtctgtgtgatggggagaagagttgtgcctactcagaatcactggaggtgaaatacaaacttacagagaggacctggcttgaaggtattcaagaacaagaggattcagaagtgttcagtcttactcccattcttttgctacagttatcacataagctttgttgttaaatgtgggtccatgaagcttttatcattactgtccccaaagtgtgttgatagcatttcctaggaggatttgacctttgttgtattgtgattttctaataagaggcatatgattggataaaagacataatattggaaaggagtgaaaagactgggccctgcctccaattttactgttaactgtaaccctggaaacactcttttgaaaaaaagttaattaaacgagatcatgtcctttgcagggacatggatggagctggaagccattatcctcagcaaactaacccaggaacaggaaaccaaacaccacttgttctcactcgtgagtgggagctgaacagagagaacacgtagttacagggaaggggacaatatacataggggcctgtcggtggcagtgggggtgggggtgtggggggagggagaacatcaggataaatagctaatgcatgtggggcttaacacctaggtgatgggttgataggtgcagcaaaccaccgtggcacacgtttacctatgcaaccagcacgtcctgcacatgtatcccggaacttaacttaaaaaaaaaaaaacagtttcagggataaggaaaaaaaagttaattaaaaagaagttttgaaattgacaacattgtatatatttatggtgtacaatatgatgttttgaaagatgtatacattgttgaatggctaaattaagctaatggactatcctggagacattcttatctcctcctgcttaatattcccataaatgaaatctctcaggaatctcttgagacaggacggagagtggcaagtaataggttatccctgaggataaaagcaaacataaggtctttgcctggcagccattctaacataggtgtgcagttattcagtggaaggatggggacagagagggagcatgagtcagtggggctggaccggagagctgtaaagggatcaggaagatggggacggagagggagcatgagtcagtggggctggaccagagagctgtaaagggatcaggaagatggggaaggagagggagctgggctcagttcatgtggaggcagaaaagagtcctgaaggcgggggaggatgtggatggagaagtaactgaggtcagttcacgtggggctggaccaagagatgaagggaaattgcagaggatagggacagagaagtagaaaagatccgtgcatggggtgtcccggagaggtgcaggggagcaggggtagggggaagggagtgagagggagcagggatcagttcatgtgaggatgcagctgagttttcatgggagtgtcagtgggtgggtttgtagagttagtggcttattcatgtggacaatagagttgtgagggagtgaggggaaatgacagttcatgtggggctggcccaggaagctggagggggatgaagtggcgatgcacacttagagggagcagatgtcagttcatgtaggctgtaccaagagatgcagaaggctgaatgggatggcatgggagaggcattcgaggccagctcctgtgcagctgcactggagagatgcagagcgtcagagagggaaaggaaaagccactgaggacagcttatgtgtggctgtatctgcagaggtagccggagtgtggggcaagggaaaggagagggaacggagcttagttcacgtgtggctggaccagagatgtatggtggggaaggggaaggaaaggagatggagctgagttcatgtcatggagggctggaccagagagatgtagggagagtgactgggtaagttctaaggggtgtgaaggtggcatatgattgcataaagacatatactattggagaggagtgaaaagactgggccctgcctcccattttgttgttagggagggagaggcagggtgagtgggttcaaataccggtcatttcagagctgcaggggacaggcagggagacagaggtagcaggggtcagcccttgcgggtggaccagagagatggaggagtggggtgggtttggaatggagaggtaacagaggtcagttcatgtgggactggaccagaaggacactggggagtgggagaagatcagaagtaaagggactgaggtcagttcatgcagcgtgggacggaccaatgtagggaggtggtggggaaggggcaggagagaaagcagagggcagttcatgtggggctggaccaaagaaatgtcggttgcgtgtagggattgggctggagagagggcaaagattcattcatgtgcagctgcggcagagggcagtagtgcaatggggggagacagggcacaggagagagcagagagcagttcatgcggggttggactggagagctgcaggagggtgggggtggaattttgaactagagaggtcagagattgcttcatgtgaggttgaactaaaaagttcaatcagagttggagaaaaaggggaggaagagggagcaggggttccttcatgtggggctggaccagagggatgccagaggagttgagggggatggaaaagtagagggagcagagattagttcatgcaaagatggagcaaacaggtgcaaaggcttagagacatagggagcaagagaggtcatctcacaatggactgggtactgggaaggagattgagcccagagttagttcatgtggggctggaccagagaggtagagggggatgggggggataaggggatggggatggagagagagcagaggtcagttgatatggggttggactagagagatctggcgggatggtggagagggctagggaatgcaggccagttccctgaggatggaccagagagccggaggggaggaagggtagggggacggagagggagaatagtcagtttgtgtttggtcttgtgggcctccttaataacttagggttgtgctaaatttccttgaaaaacctgtccagcagattcgtcttttctttgcttccaagtgttagaactactgtgaacagcagaatttgttggtagacatgctcaagcctgatataacgaaatgatttaagaaaggaggtggttcagtttctgtctctgtaagacatggaacagctgctgggactgagatttttttaagttctatgatgaccgggaagagaagaaagaacacattttttaccacttttcttgtttaaccacctctttaggaagcctaggagttagactgtgaggttagacccaggtgtctcagggaccacgtggctccctaccatccactgggggaaatttccttaaagttcaatctggcttttgagaatgctgacctttcaaatgcaacctcaagtgccaggatgtctgactgtcattgggccaacctcaaaacttgatcttagagcagctcttcccttgagggactcctgctgtcaaggataactgtattccagggctgctcaactttattttatgtttttgtcacacctttgaatactagaattttgacaatatgctagaaggaagtaatacactcaaaacaacagtttaacgagaattgcaacttagtcactactctaggccagtaggcagcccactatacacttagtcacccttcagttggactggaccggcttgctgtccagatggtgtcaagttcctgcacagtgcagaagctacccctttttgagctagctcctccatcaccattagtgagaagtatcttacagcaggttgctcctttctccactccatgtctcatgacctgcttagttcatcgtcctacatgctggaagccgctggaatggccacatcttcagttgtagcaaaaatagtgcctctgcatcagctgcagctgtgaagctgagacatcatccttgtgtgccatgctcggacatatcggacccatttgctgacccaaatctctgtcagtagccctccaaattcttatgtgggtttgtggacccatttcaaagaacatcgccatcagcacttgctgtatctggagctaaagttaccctcatttctagcttttccctgcagcctcccagtcatctggtcttccaagcctctccttaaccaccaccgtttgcctttatctttctgatgcagtggtttagaggattgatgtcattttcattttcttttttgtctttgccttatatgtcacccagactttccctacagtattcacactcatccacccctttctttttcatttctgaagccaccacctcaactcaaattcagattgctgaaatgtcctcctagctgatttccctgtcctgtcttttcccaagacaatctgcagtactgtctttgtcatgccattattttgctcagggaagagacctagccttttgattcagccgcccctggttaaaatcccaactcttcaacccagcagctgtggttttgggggaaaggattcaaccccctcaagcctcagtttgctcatctagaaaacaaaggtgcagagaggtcaaagacagcaaacaaaggctagcgtagagcctgatgcctctttgccacagatgatggctgctcattaattagcctgtttttctttttccctctgacttggacaccgtgtccttaatacatgtctatgtgtgtttcccttcatataaagttagttgctatatatatatgtactcatgtctctgtcattgtccctactgaaatattgtccccccatcttatcccaaatctgtgttcttctccttgtgaaactcctcctcagagctccctccttccagaaaacttgttttcaaatagaggactgcgtcccagctggaattctggaagacagcagtcttgcagatatgtcccttgccactaggtggggtgccaggacagagaggttctgaggcagtgccactaaattaccttgaattcagcagtggtttaagctggatcttcctagtgccccaagagggctgtggtctcatttagccttggagggctgtggtctcatctagccttggggtgtgatggagataatgccacagtggggagaatcctggtggggctgtggaccccttggaaaaagtcaccaggtgtgggcactgatggaatgacaggtcatttgaatggataccctattaagtctagctataagtgaacaaaatgatacatttgcatttttgagtgtgagcgatcaagattgcttacctgctacatgggctcattgagactccctaactactttgaacacttctcaacagaagagagcagggtgcctttgatgtcatcatagccgggctttgtgcctggtacaatgctccatccatccatcatcaggtttattaacttactaagtttgttgatcctatagcaaggatttattaactcattaaaaatgtctagcattctgtggctctttttcttcctgaccattatcccttgttatgagttgaattgtgacctctaaaattcatatgttggtgtcttaactgctaggacgtcagaaggtgaacttatttgggggtagggtatttgtggaggtaatcaagttagagtgagtttacaacagtaggccttaatccaatacaaccagtatttccttatatcaaataaatatataaataaatactggaaatatatacatatatgaatactgggaatatacatatataaataaacactaggaatatataaatatttccagtattatagtgcaaaatatatatatatttacagtatttatttccttataaaaggagaaatttggacagagacacagacacgtgtagagggaagatgatgtgaagggacacagggcaaagacagtcatcttcatgccaaggagagaggcctggaacacatcctttcttcacagccctcagaaggagctcaccctgctgacatcttgatctttgacttccagcctccagaactgcaagaccatgtagttgtgttgtttaactcctcagtccatgggtactttgttacagaagccacaggaagctcatacatcctctcttttactgaagaactttctctgttcccctaagtgtctcaaccagaagtgcacacagtaatgttgatgaaacaaaagctgaacttggaatctatgctgcagaactcatgacttcatggacactggatgtggcctctcctgagagatccatgagcccctgggtgtgtgcagcattgctaccagaaagctttcttctcaacttggagactgaacttgaacatgcacgtgagtccatctccttgcgagatgttggatgtggggaaatatttgtgcaatccctcatacaaatagatccagaaggtaaaccaatgattaaaactgagtcagcaaaccatgggaacgatgaataagcagaggcagggtgacagagcctccggatgtcgttggtggtgggattttcatgtctaacctactatatgtagtctaagagacatgttttcagggtgaacggggctatctgaaagacagatgccaacctcgtaagaggcatcgtggggtagcagtaaaatgtctctaaagctgaatttctggggttccaccactggctctgctcctactagtgactagtgcaaaatgagtgacctgtagcaagttacccaaagccccagtacctcgtttgtttcatctgtcaagagtgagggtggtattaatataatctacttcaagggcagttgtgaggattaaataagctacatgacagtcaatcaatacatatttgttgaatgaatacactaagaatttggctgcaatcttcaactctagggttaaggagttacatcattaatccaagtgctgcaattgaggaatatacccttagaacaggagtttctaacctggggcacttggatttcaggtgtccatgaatcgcctggaggagaattcctgaaatttccttaaattccctgaaataatgcacatgtggcaattttcatcagatttgttcaaagagttcacgagccaagattcacacccactgctctagatttggacatcattctggggggcatggagaaaaatatgcaaacccatagcattgtgccatagctctgtgtgtgtgtgtgtgtgtgtgtgtgtgtgtgtgtgtgtgtgtgtgtgtgtgtgtgtgtgggggggtgggggctggtttagagatcctctgtccatacagacattggctgagttcagcctgcttcctggcccttcgggatttttttcagtgaggcagctctagcattatttttatgccatgcctgagggcatgaggctgctgcttccttgctgctctggggcctggggatctctatgacgctttctctgtcactatctagacatcccctgcaatcaatcgctccttggagcctctgggatctagcaacttcaccagctgtctggatttcccgctctctctcctccctctcctccaacttttctttagcttgaagatcaatcttctggaaggaaaaatgccaacaaaagaggatttattttcttccaagaaattgctctcacacttccttacactgactaaaaggcattttacttatctgtcttcagcattttcttaaagcctcaattcattttcagctttagctttccccagattaattattcgttaggatccacaccatttcgtatgtgctttttatccatcactagatctgtcccctccttctatcttttgcatttattcatttattcatttatccactcactcagcaaatacttagcacctattccgatccaggccttgcagagaaaaaaaataaagtccctggcctcgtggaatttacattttagtgaagaagacaggaaacaagctcaaacaaataaaggggggtaaggaggcggaaatggatggagggggtgctattttggggagggtggtcagggaaggccttgccatgaagccctgtaaggatctgggaaagagtgcccaggcagatggaacagcaagtgcaaaggccctgaaacagcaacaggcttggcacaagtgaggaacagtgaagaagcatgtgtggtggcagcaggaggcaggcagtgagtcaggcctcacaaaccccataaggtaagggtatgttctatgggggatgaggagtcatcacggggttctgagcaggaaagaaacccgaatagcattgccactgcactctctttctctccagtttggcctacacgcttttgtttttttcttaatctttcttgcttagaattttaactgcctataatgcccatccggacaattgctcaaggcaccagagcttcctgctatgggttcaggctccctaaaaggcccatatggctagtgtgatggttaattttatgtgtcaactggactgggccacggagtgcccagacatttggtcagacgtcattcccggtgtgtctgtgagggtgtttctggatgagattagcatttgagttaggagactgggtaaagattgccacccattatgtgggtgggcctcatccaggtagttaaaggcctgaatagaaaaaaaaggccaactctcccccaagtaagagagaatccctcctgcttgaaggccttcaaactgggacattggctttttcctgcctttggactcaaactgcagcatcggcttctcttgagtcttgagcctgctgggctttggactggaactatgtcatcagctctcctgggtctcaggccttcgaactctgactggaactacattatcagctctcctggatctccagcttgccaactcaccctgcagatctggaaacttgccagcctccataacagtgttagtcagttccttataaccaacttgtatatatttatatataatatagacatagatttatatttataatctaaatatatatgtttaaatatgtatatttatatgtattatgttactccttacaaatgtatctatctttcctattggctgctgctctggagaaccctgattaacacaggcagcagagggcgatctctcaccaaacactggctgtttcccacgttcgtcctgttggatagttgttttctctgaaggggtgaaaaatcttcctcattccttttttttccagacaaaagaaggtaatttcagagaaagagagaagcataaagagttgttggcatatgtgataggagaagttcagctcagatcaggcctgagacgacctaggcaatgcattctacatgaggcagacaccaaagttcttctgctagtgacttcagccaacacagcatactcttcctggaaatcaaagaccacgttataaccagcagtacaagctaaagggcaaaattttcgaagtggaacttctctaacagaaaaaaacaacaacaacagtggaacagttggaaagaaggaagaaaactgacagtgacagaatggctatgtttccattacgcataatcttgcattcacgcacacataagaatacaaatgcaaaacaacacaaaacaaaaagcagaatgatacaatggactttggggacttggggggatgagtgggaggggggtcaagggataaaagacaacaaatatggtgcagcgtatactgcttgggtgatgggtccaccaggttctcacaaatctccactaaagaacttactcatgtaaccaaataccacctgcaccccaataacttatggaaaaataaaatttaaaaaaaaagaaatctgtgtttgcccacgtataatgaagatattttcctgtgttttcttctgtaagttttatagttttgttttccatgtttcgtgtctatttcatcttaattttttggtgggtggcaaaattttccttctgaacccatatggagactcatttgttccagcatcacttattgaatagtttaccttttcccaactgatttataaatatataaaaattctgccataaaaaaaaatccatatatgaaaaaaaaagaacacaaatgcagagaacaagatcaggaaagatgcataccaaatttttaacagtgattttctctggagaggggaaggaggttggacgtggctacagtgaagtggatttttaaattctattctgggtttgaatttgtcagaacaaaattgtattcatatataacatttatacttaaaactgttcttagatacagcttcacacatgctaggacacgctaggacggctataataaaaaaataaggaaaataacaagtgttggcaagtatgtggaataactggaacctggatttattgctgatgggaatgtaaaatggtgcagccaccttgggaaacagtgtggcagttcctcagacggttaagcatagaattatgatatgacctagcaatcacacttcaagatatagatgcaaaagaattgaaaacagggacttgaaaagatatttatacaccaatgttcatagcaacattattcattatagccaaaagtagaaacccaagtgcatcccaacagatgagtggataaacaagatatggtctagccatacaatggaatattattgagccacgaaaagggatgaaactctcatacatgctataacgtggatgtactattaaaaactacgcttcctgataaaaaccagacacagaggacaaatattatatgattccacttatatgaggtacctagaataggccaattttagagacagaaagtagaatagaggtcactggaggctcaggtgaaggggaaagaggagttactgttgaatgggcatggagtttttgttgatagtgacaattttggggtatagatagtggtaaaagttacacaacattgtaaatatatttaatgccactgaattagcaacaaattgttacattgaaaaagattgtgttatatatattttactacaataaaaaactgacaaaatacttaagagaaaggggtgttatactattatatccagttgcaccctttcatagaggagagaacagtggattccaggatctagagaggggaagcctcagttttatgggtagcgggcttgcatgaagcagcaaatgctacagaagtttctcgcagctggaatataatgagacatgagaatcagctgtcatcaggctcacagtaaactttgtgagtgaatggactggttttatctttgctcatcattgcaaccttagtttctagcacggtatctggtgcctgtaggcactcgataaacatttattgaatgaatgaatgtatgcatgaatatctgtgacttcctagtaatctattaaaaaaaaactatctgtcccatcagtttgggctgcattgtcaatcatttgatgcataattagaagaacaggcccataatgcaaatatttggttgtcattagcatagagatagtgtattagttgggccaggttaattgcttcatcaaacaatttctgtatttcagtgagctgactcaataaaggattatttttcactcatgttcaaagtcagtgggggtgggttggggtggaggccgggctctgttttattcagggtattagacatccagcttcctcttgtccagtagttccaggggcccctaggcactcagagatctccactggcatttttttttttttttggcaccgggctggcagatgaatgaaaagagagaacatggaagatcacgtgtgaggtttgagtggccagacctgcaagtgttaaacatctcttcttcccacatcccattggtcagaagctagtggcacataatcaaaagggattccaggaaatgtggtctaactgcatgtaaagcaggaaaaggaaaccgtgtttggtgaacatgcagcatggtccatgttgcaggtaatgttggaagccatagatgagggggagtgctcctaggtaaactgtggtgagcctgttaagagaatgtaacccagccccgaaatcctaggagcttccgtgtttaagaagtgggaagaggaggagaggccaagaagggggatggaaaataaggaaagcaactgcaggaaacccaagaggatggaagggcacagaagcaaagggagaggaagtggtcacctgggtgaagctagtgaaggctggagtttgccctctggatttagcaacataagctcattgaccttagcaagagcagtttgtgtggtgtggtgggagtagaaataagattgccgtggcttaggattgaaaagtggctgaggaaacagagggccacatgcagacgttttgagaaatgtgaccgtaaaagggtggaaagagagttagcatggtagctagtggccatgtgggggtggcagtgggagaattttctttttttaatgggaaagacttgagaatgtttgattgtttagatgaaagaaaatacagtaagtaagagtgtggtatactaccaggaacgaataaatggactattggaacagaagaaatagtcttgaaacaggcttatgtgcatatggcaatctggtttatggtaggggtggtattaaaaattgatgtgaaatgataggccgtttctgagacagacaggcatgcacctatgtatgtggtaatctgtgtatattgtatactttcatttttccagaaaggatttaaaacagcttaaaaagatgaattctatgcaatagagtaagacaagcgtttaaagagggagaaaatgacgtggggacaatgaggggaaacatgcatttaggttttacaactttaagtatctctttgatgctgactgctttaaacgtccgtgctaagctgatgttaagtattttgatcaactagtgctgtgatctattagactgataattctttatgtaacttgctctgcaatgtcccatttaaggcagagattcatatttattctggacgttgttctgaaaaatcatgcagtttctgctctttgctccgtgtactgtgcgacagcctttgaccacaagcaataaaacctgacatgaacgttagacaggcactgactgttctggtagcagaaatagcttctaaatcagacagcaagcttggtttcatttttatataatcatatctgttcctgaccccagatggcaccccatgagccatcttctgctgtatttactctgaactctttctcctaagctgttggaaacccctaagcctttgcttatccttatgtctacaatgtccctttattccctgtctcctctcagcagactctttacaagatctagcttacctgtctgtcacacgctcgaggggatgctttcaggattcctccatgctggatttgtactcttctctgtgcttccccagcccttgttctcttcatcatggcacggaagcctcgcagcagagagatgggattttctttctctttttgtaaataaagatgggagtcttgctctgtcacccagcctggagtgcagtggcgtgaccttagctcactgcagcctcaaactcctgggctcaagcaatcctcccacctcagcctcctgagtagctcaaactactgtcacatgtcaccacgcctggctaaagaaggtgggatttctatttaaaaatacaactgccatatcaacaagaatgatggttccatgggagtgtacatttgttaaatttttcactaagttggacacaatatctgggtaatttattgtatgtatgttataccccaataaagcaccattaacctaaaattgttttaacaaaagaagaaagaagaaaaatctccttaactatctgcagttgcttttgcttttcaggcgagtaacatggttgtccctgggtagatagctctttgtttaggaagatacctggctgcctctgggttgaaatgagggagtcacagagagagctgaattgctcctccacataaaggcaacagaatctgtgatttcctgatgtagctactttaatagtaaaggaagaatgttcccttagtgctggtgttcatgaaccccatgcacctggaactctggtgtgtgacacttataaaggcttgtcatattcactcttttgtttggtccttagggttagggtaaatgttgatatggctccagagtccttctgtcaaaggatccagccacggcagtcctcttagtctagggcaggaatgcaaaccacagggaagctttgagtctggggttgggagatctgtgccaggaagtccctgagcccacagggcagcagagggatgggcatgcctaggaaagggattcagaccttctgaattgggcgaattggggtgcaattccccctaggctggtggagtggaaaacacaggcttagggacagatcaagctgcgttcaagtcctggcatggctgcctactggtttgaccctgagcaagatagttaaccccttaaagtcttgggccctttctctgtgaaagagtcataggctttatttcacaggagtgggaggaatgaaggatgttatactagtctgctccagctaccatgacaaagcatcacagactgggaggcttaaaccataaaaatgcatcgtctcccagatctggaggctggaagttggagaccaaggtgtgggcagggttggttcattctgaggcctctgtccttggcttgtagatggcccacttctccctgcgtccgcacatggttctccctctgcacaagtctgtgtctgaatctccttttttaacatggacaccagtcatattggatcagggaccaccctaacggcctcattctatcttaattacctatttaaaggccccatgtctaaacagtcacattctgaggtactagggcttaggaattcaatatatgaattttgggggacaccagatagcccctaacaggtgttgtcctgctgtcacctcctcagctcctattccaattgtattttcttaatgctgtctgcttccctacgagcctgagagctccctaaagcctggatttctccagttctgagttggatccttagaacaagtgagggagctgtgattccagctacccctacctttctgccacgggaaccccaggaatgccttcccacactgaaggcctgtttcagtctagttgctggtgcctgaaagcagctaagtgcaaatgcattagcccctgaggtgcactttcagtcacgtgaacttagactaagtacatctgctccctacgggtcagctttctctcttataaaataaaggttttagctaggactggctataaaacttgtggggcctagtgcaaaataaaaattcagggccccttgtttaaaaattattaagcatttcaagtcagtggcagtagagcattaattcaagcgtgcagagcccttctaagtgtgggacgctgtgtgactgcttaggctgcacactcctgagactggccttcgttctaatcttggaccttctcttgaaaccgagcaggtgtatactgtgcgataatcttgggaaaagtgctttagaaacagccaagtgctggacttgaaggttgcaagcttcccaaagtctactgtcttcctcttcctggcatccgttgggctcatttggacttttctaatcagtttgcttacccagagcactccctcttcatccccctctcaagatctcctcattcaatgcacagcatcctttcgcttggctatggggctgggtgccccaaaggatcagagtcaaaggggaccatccatcccctaggggtcagacccacatctctgccagcacctctgccctggggctagagctgtcttgctcatctggcagcctgggaaatcccagcgttccctagcaacaagacccatctggagctgttgctagggaaaccctgggatttccatagctaccgagaacacaccaagcatctctgctcccacagctgaatatatctggtgccagcagaagacgggggaagggaggtgatctgctgctgccagggggggcagagctggtttctctgaatctcattacctgcacaaagaggggtaaacaggtcaccagggacaggaccactcctccaggctgatgagtagacagtccttcctcacacaaaaacctccaagaagtggctagtcaatttggaactgtatagtccgttggggtcccacagtacctgctgcctgtgggacagaaatccccagactgtgttgtatctatatatctgtgtgccctcccactctcagtggctgggatctttccaaagccagtgaccaaggtctttatcatgggctgctgtgtcctcagtgcccagcacagggaaccttctccttggttgtctggggaaatctgtgtgttccttctcagaataatgtttttgaaggcatgaaataaaattgataggaatacaaagaaagctattttattgaaagacagttatcaaaatatttttctaagccacaattgtgatgccataaaatgtatgtgcatcttcattaatgtgttaaataatagaattgaggaaaggtctaataactgttgtaatttggaagtagtgacaagtataaagcatatttgaagagctgctgccacagttaatgtaatatgaaaatatcagggatttcactcggtgactgttataagtactgctaatcttcctgtggttgattgcctgcattcgttatccatgatggtaatttcaactagaggttagtaaaaatttaaaaaaaaagtattctttcacgatctaattgcatggactccctaaattttatggaggttgtgaactctgggtttggatattgcccaatgcgtgaatgaataaataaattcatgctcagggtccttgatcaagtgagtggctcagcaagagaaagggaggtcttgtcaccctcagtcaccatgctccttgtcctctcttcctttaagagctgaggagaatctcaacaaatgatgttgggacaacttgttatccacatgcaaaataatgaaattggaccctcactttacatcatatactaaaattaactcaaatggatgaaagacctaaacacaagtgccaaaactgtaaactgaagaaaacagaggggagaagcttcatgacattggatgtggcaatgctttcttggatacaatgacaaaaatacaggcaacaaaagaacaaatagacaaatgagactacttcttttttttttttttttttttttttttttttttggaaacgggatctcactctgttgtgtaggctggagtgcagtggtgcaatcatggcttactgcagcctcgaactcctaggctcaagtggtactcttgcctcagcctcctgggtagttgggactactggcacgcgccaacactcctggctaaaactttttaaaaattcttttaaaaataaaaacagggtctccctacgttgtccaggctggtcttgaactcctgggctgaagtgattcccttgcttggcctcccaaagtgctgggattataggcatgacccaccacgctggcctacatcaaaattaaaaacttctgcacatcaaaggaacaatcaacaatattaaaaggcaatcaatggaatgggagaaaatatttgcaattcacacatctgataaggggttactatcaagaatatataaagaacttttacaaccaaacaacaacaagaaacaagcgagatttaaaaatgggcaaaaggcttgaatagatgatacttcaaagaagatatacaaatgaccaataagtatatgaaaagatgttcaacatcaccagttagggaaatgcaaatcaaaactattgtgagataccacctcacactcagtgggatggctagtatcacaaaaacagaaaacaaatgttggtgaggatgtggagaaattggaacccttgtgcacccttatacaccatatgtgggaatgtaaaatggtggaagatagaatggatgttccttgaaatattcaacacagaattaccatatgatctagcaatctcgtttctgggtatgtatccaaaagaactgaaagcagatcgaagagatatttgtgtactcatgttcacagcagcattattcataatatccagctggtggatcaagacaaatttccatcaatggatgaatagataagccaaatgtggtccatccatacaatggactattattcagtcttaaaaaggaacgacattctgacacatgctacgcatggatgaccctagagagcattacgctcagtgaagtaagccactcacaaaaggacaattagtgtaggattccactgatacaaggtccctagaatggtcaaatccatagtgacagacagtagaatggtcagtgccgggggtagggggagggagaatggggagttagtgtttaatggggacagaggtttagtttgacaagtctgtggatggatggtggtgatggttgcacaacactgtgaatgtgcttaatgtaccactgaactgtacacttaaaaatcatgaagatggtacattttatatgatgtgtattttaccacaattaaaagtaaaaagaggtgaggaaaggagcagcagccttgaaaatgccttgtcaggaaagaagctgcccatgaatcctagcagtggcctagcagggaaccaatagcctccctgcttggttctgcaacctgaggaccagtgagctagtatttgggacaaatgacccctactcccacactgccttctgggctattggagaaagatgcctgctacaagacgctgcactgcaggccctgggggatctgccaacagctctcagctctcagccctgccagccttctgctttccagctcctcatgtcctacaggctggcctgagacccacgcagacatagtggcttcttagccaaccacgtggggaagcaaagccagatagggaattgccccacaatctcgcaatagaatcatcacagggcatgggagcttggtaagcttgagcctctggacagggtgagcctcacaggccacagaagctcaagggcagaaaggcagtatccacagggaccccagcacagcaaaaaggagttttgcttgagggggtgaaggaaccttgggcttcagattttagctaagcagggagagtggcaggagcccaggctggacaggaggccaatgtccccaccatgcaggaccccatgggccatggaaaggggtctggactttattccaaggaaagtggggagtccctagaaggttctcttattttatttatttatttatttatttatttatttatttatttattttttagacggagttttactcttgttgcccaggctggagtgcaatagcgtgatcttggctcactgcaacctccgcctcccaggttcaggcgattctcctgcctcagcctcccaagtagctgggattacaggcatgtgccatgatgcccagctaatttttgtatttttagtagagatggcgtttctccatgttggtcagactggtctcaaactcccgacctcaggtgatccgcccacatcgacctcccaaagtgctgggattacaggcatgagccaccgtgcccggcctattttattgtgttttaaaaattctgtgttttatgtcttcaaatatgtttagcacgttcattttatagtcactatctcatcatgctataacataaggcccccgagcaatcctttggcatcttaaggtctggtttctgattgggccagtagttttaggagcttccacagtaaaacgtctttggtgaactcatcatcattgctgtgcagggaactgctggcagtggcagtggtgaggaactgccctcagctgacttccctggacctagaaatgaacagtgggagcagaaacgacaaaggatactttgtgtttcaggctaagtgtagatgagcgacttgtttgtcagcccaggtgcatcactctctagaaatttcagagatctctgggcaaaggtttgatgccacagacagatttgtgataatagctataagccaattgaggggtatggactcagtgaaacatacctctgtggacagattctacatgtcctaaattatttaccaagatctggatgcaaaaacccagaatgttttttcagtccaaaccaatcaactcacaaaagaaaaacaggtccagaagtgggcagttgcctgatcagagttacacaggaaattcaggactatgactcagtttttctactttctatatacatgttcttttcactacaagatgtcattctacttccagtcatttgtatctcccaatctgttctgcctccagtgttctatggctctgttattgacatcaacaactgctgaatggcccaaaccggaaatctggaagtcatcatgacacatccctctccatcagtccccacatcctatccattgccgggtcctacctattcctcacgtcgattcagttttctccatctccactgccttcattccagtcaactaacaaacatttattaaggacctacaattctgaggcaccattctagatattaggacacagcaagtgaagaagataaagtccctgccctcaaggattctacattctggggtgtgtgtgtgtgtgtgtgtgtgtgtgtgtgtgagagagagagagagagagagagaggaagagagtaagaatgagcagtgatggacaactaaaaagaaaaggtaattaaatgcatgactaaaaccattgagtcatacagtttaaatggatggcgtatatgagatgtaaattatatctcaatatagctgtttaaaagtgcctattacttactggctgggtgtggtagtttatgcctgtagtcccagcactttgggaggctgagacaggaggactgcttgaggccaggaatttgaggccccatctgggcaacacagcgagaccccatccctatacaaaagataaataaaataaaaatgtctatgatacatttgtgcttctttttctgttaaactcctgtttatttatttttcccattttttttctagcaggttatttgtcatcttcttgttagttatatgagtttcttacatattttttgtgtactaatccttagttaaatatattcatttaaatatttttctaagtgtgaaatatacaaaaaacctgcaaatacatacagtttagcagtgattatgaaatcagcactcatatattcactacacaagtctagatatagaacattatcagcaatgcagaagctcacctatgtaaattgtggtcaagtttctccacggtaaagggagaattttgtaataatcatcttattttttccttttgttgtactaccttgcaatacatttattaacaatattgtttagtgtcacttgagttttaaactttttattcaggtttaattttcaatagttactgacatagattttgagcccatggttatatgagttttgacaaatgtgaatacttatgtatccatcaccaaaattaagatgtagaactttttcatgacctcagaaagttctccatttcattttatatttaatctttcctcatccaaggcaccctctattctgtttgccatcattataaattaattttgcatataattaaaatcatatagtatgtactctgttgtgtcaggattctttccctcaacataatgtttttgagattcattcattgtgttgcatgaatcagtattttattcattcttattgctggattccattgtatggatatatcacaattttttaaaccatctacctgttaacctgttaacagacatttgggttgttttcatgtttggctgttattaccctcctatgagcatcttatacaaatatttctgtagacctatggcttcatttattttgagaaaaatacttagaagtagaatttctgggaaagggctagtgtgtgcttaaccattttaaaactgcctgtgtttggtcagattaagaggtctgtatgaaggaacttattattggaaagtactttcaggaacaacatctgtgaggaagtgaaggaagtagggaggaagaagtggcagagaaagcattcacctgtggcccagtcatgatggagacttcatcctatcccatggggatccttgtggctgacatgtcccttcagagttgtcttaaattgagtcaaaggggcccagtctttatactcttgcacttacaagtcattggatgtagattattcctagggagattacataatctttgattaggttataccctccaattaaaaagaaaagattgtcatatttgataaaaagaatgattcaattatatttttctataaaaccctactttaaatatgaagaaacagataaatcagaaataaaagaatgctaaatgatagaacatgaattaactatactaacatcagatgaaatagatttcagagcaaggaatattatcagggattaaaaatagatatttcataatgacaaaggagccaatctacccagaagacatactaattctaaatgtgtatgcacctaataatagaacttcaaaataaatgaagcaaaaaattatttataggagaaatagacaaatccacaactgtatttagaaatgtcaatatctttctttcaataatcgatagaactagtgcacaaacatcaataaaaatatggaagacttgaacagcattatctgtgttcgtaacataatcgacatctacacaacattccatccaacaacatcaatatacatactcatgtcacattttttaaaggtgcacatagaacatttaccaagatagcctatgtcctgggccataaaataagtctaagtaaataaaaaggattgaagtaataaaggtatgttcttgctcagtagcagaattaagttagaagtcaacaacagaattatatttgggaaattaaaaaatatttggaaatttaaaattatacttctaaataatccacacatcaaagataatttgtctcaagggaaatttaaaaacttttggaactgaattaaaatgaaactggataaagaaaatgtggtatatatacaccatggaatattatgcaaccataaaaggaagcagatcatgtcctttgcagggacatgtatggagctgaagaccattatcctagcaaactaacacaggaacagaaaaccaaatactgcatgttctcatttataagtgggagctatatgatgagaacacatgaacactagagagaaacaacacaccctggggcctattagaggctggagagtgggaggagggagaggagcagaaaaaacaactattgggtactaggcttaatatctgggtgatgaaataatctgtacaacaaaccaccatgacgcaactttacctatgtaacaaacttgctcatgtacctcaaacttaaaataaaagttaaaaaaagaaaatgcaatacctcaaaaattgtggcatgcaattaaagtagtacttagaaggacatctaagtgcttatattagaaaaccttatgaaactagaaaaagaagagcaaattaaagtcaatatagggtaataaacagaaaaaccgtgaagaaagcaattatactaaaaacttgttccttgaaaagataaataaaaacagtaaatttctaaacagacagctcagaacaaaatgagagaagacacacattaccaatatcagcaatgagataggtaacataaccacagatcctagagccattaaaaaataatgaaaatgttggcccggcacggtagctcatgcctgtaatcccaacaccttgggaagccgaggctggcggattgcctgagatcaggagctcgggaccagtctggccaatttggtgaaaacctgtctctactcaaaataacaaaaaatttagccgtgcatggtggcgtgtgcctgtaatcccactcgggaggatgaggcaggggaattgcttgaaccagggaggtggaggttgcagtgagccgagatcgcgcccatgcactccagcctgggcgacggagcaagactgtctcaaaaaaaaaaaagagagagaatattatgaacaagcttgtgccaaaaatttcaacaacttaccacaagtaggcaaatttgagacagaaacaataattggacagaattcaacatccatttatgatttaaaaactctcagcaaattagtaatagtcagaaattactgcaagttgataaggagcatgtacaaaaaaaaaaaaacctacagataacatcattacttacagatgaaagactgaatgctttccgcgtaaaattaggcaaggatgattgctctcagatcttttcgctcttattcaacatagtactagaagctctagacactgtaaaaaagcggagaatccacagatggcagaaaagcacatgaaaagatgttcaacatcattgcccattgggaaatgcaaatcaaaaccttaatgaaatatcactataatctctcataacagctacaataaaaaatagtcacggtaccaaatgttggcaaggatgtggagaaattgcatcactcatatattgatagtgaatgtaaaatggtacagtcactctgaaaaggagtttaacagtttctaataaaactaaatatgcaattagcatatgaacataaaattaggctattggccatttattacaacaaataaaaacttaaggagatttgtcttcagtgttcaaccttgatgcaacccttatcttgcatgtctggctaattgtggacagtttttatttatccgtaattaatggccaatagcctaattttatgttcatatgcaaattgcgtatttagttttattagaaactgttaaactccttttcagagtgactgtaccattttacattcacatccttgccaacatctcaacccaggcccagaagccctatcaaggtgagtggcccactcaagctccgactcctaccctgtcctgtcctggctctaacccccaccccagcctgcaccccttctcatgaagcttctgttcccacccctcttccatcctctcccccaaaaccaattcccttctgtgatctccctgctgtccttccaggttcccaagacaacctgaaagggaaaaagaaccctgtgagggagttccaggaaaaaagcttctccctaaaagacccccgcttcaagcaaacctgaggaaggaagtgggccaacactatctagccactgtaaccagctgaataaggaactcaataaaaatcagccacagcaggaccaagtaagccagaagacctacctccaccatctccagcatttccctgcgcagcctgtaatttcagggcaaggcaagagactcaaatctatctgagaagtccccaaaggtctgacccgccccccacacccccgccggagaaatagccaacaaggtctagagtacattttgcgccccacagggtgatgaaaataaaatgaactgttgtaaaatgatgtgtgggtctgtatattctcaaatggtggggagggagggaggaaggaagaggcattggtgtgggaagggagggaggtgggtattctgggtttggggccaaattatatatatcaagtatatctcaataaaactatttttagaaattatattctgtgaaagttgtcagaatcaaaatggagtcactaatgttaaaaaaccactgacaaatacagctgcaaaaggttatgaaggaagggttatcatgtaagaatgcctgataacaaaagagtctgcaaaacctacagccttgtacaaaggccattaccaccttgtgcaaaaaatacttctgtgagggcatccgcctagcaactgcttgtccaaccttggcctggcatcacccttgttattgacctttgtagtcaatgataattatttccttcttcttttttttttttgagacagattctcattctgtcacccaggttgaagtgcagtggcacgatctcagctcactacaacatctgcctcctgggctcaagccatcctcccgcctcagcctccaagtagctgggaccacaggcctgcaccaccacatctggctaatattttgtattttttgtagagatgggattttgccatgttggccaggctgttctcgaactcctgagctcaggccatctgccctcctcggcctcccaaagtactaggattacaggtgtgaactgtcacgactggcctaaggataattatttcaaaggaattatgtaagtctcctcattttttccttttaaaacctttgtcttcctttacctctctgaatacacatcatttactgtggcacgtgtaatcccactgcaatgctctattcccaaattttcttttaaagagcctctctccatataattaggttgacaattccctgaagagaaaaataacttttgaaaaaataaggataaaagattgggggaagagcattttatcacagaaattatatagacatactggagtatggtggtaaaaatcaagattggcttttattaattttattgttttaaaattatctgtagggattcaacttccacttctgggaagatggagtactctcctatttctcctgctaagcacaactaaatgcccagaatgttatacacaaaacaagcagtaagatgggtctgaatggtagagaaaagaggagactggctagggaccttggaatccaaggaacaacatagcatagcggtgagttccctgtgttttcttttctttctttctttctttctttttttttttgagacggagtctcgctctgtcacccaggttggagtgcagtggcatgatcttggctgactgcaacctccccctccagggttcgagcaattcttctgcctcagcctcccgagtagctgggattacaggcgcacgccaccacgcccagctaatttttgtatttttagtagagacggggtttcaccatgttggccaggctggtctcaaactcctgacctcgtgatctgcccacttcggcctcccaaagtgctgaggttccctgtgttttctttatgccttatatatcccagaaatggagctaaataagccaacaggtacagggagttgaggggagaagcctcaacaaaagccttctctctctaaccaaaaaatcaggaaaagggtaacctagcaaaacagaaaacttttagacactagctgctctactctcaccaaatatcaacacatacaaaaaatctatggccccactcacatccacaccagcaaaggctaagaggggagcctggattgccaccctcactaggctatatcaagggctccaagtaccccctcaccagcactggagtggtgtcagaggtgactgagtagagagcttgagcttttattcccagcatgtagtaatgaagcatttccctccccacagcatgttgtttatatagctcatgtggggaacttgcacttccactcaaagataaaagtcgccctttcctctcctgactggggtgtcatcagaggaggtctcataaaaagtgaggactttcaccactgtccaggaacaatgagaccatccctacaacctgtggtgtcagcagaggccacatggggaagagtaatgagaaacactcacccctcccaaacaaggaggtatcagtagagccctagtatggggccagaactcccacctaaacccagcagtattgagtgggctcccacttgggtgtcaatggaggccaagtgaggaacttgatcttccatttccatatgtcagtaatgaagtggtgccctatctcttttgctagagtgatgtctgagaaagccagctaaaacacaaggtttaaataagatccagaataatatgacataacaaccaaaatatcaatagctcaatcaaaaaccattcacataacagaaacaggaagatcttgaactgaataaaaactcagtcagtacacatcaacaccaagatgatggacattgagaattatctgacaaagattttaaatcagccattataaaaatgcttcaaaatgcaattataaacacatctgaaacaattggaaaaaatagaatatctcagcaaagaagtagcacatataaagaaaaatcaattgatgtttttagaactgaaaaaagcaataactgaaatgaaaaacttaatggatgggctaaaaagcagaatggagatgacggaggaaacaatcagtgaactgaaagatagaacaatagaaatttctcagtctgaacaacagggaaaaaatacatcaaataaaaatgagcagagcctcagagacctgagggaccataacgaaagattgaacattcatgtcactagaataccagaaagaaaagagaaagagaatagggctgaagaggtactcaaagaaataatggcttaatgctttccaagtttagcaacactcataaacctataaattcgagaagctgaatgaatccaaggagaataaatccaagtcaagatacgtcatagtcaaacttctgaaaattagagacaaaaaaaaatcttgaaagcagcgagagagaaatgacatctcagtttagagggaaaataattcaaatgacagtgaggtttgcaacagaaaccatgaagcccagaagaaagaagcacaacatctctcaagagctgaaagaaaagaacagtcaacacaaccctacatatagcaaaaatatctttcaggaatgaagggaaaatcaagatattcccaaattaaggaaaactaatagactttgtcaccaggagatttaccctagaagaatggctagaggaagttccctaaacagaaaggaaatgataaaaagggtaatggggaattggaacattgggaaggaagaaagaacatggtaaacaaaatgtagataaatacaatagactttctttcttctttgagttttctaagttatgtttgacagtcgaggcaaaaattatagaatggcctaatatgtctttaaatgtatgtataagaaatacttaagacaatcacatcataaatggagaagggtaaagggatatgaaggaaggtgaggtttctacactttacttgaactggtaaaatgttgacaacagtagagtgagataagctaggtatatataataactaaagcaaccagtaaaaaggatatacagttgtaagttggcactcccattcttacaaaatgcttgacaaactgaaaactttttcttacacccatcagagaactgagattgcagggcaaaccactgactgaaaatgtggagcgactggttcacacaaagaggagcaggtaagatctgcttacctgtagcagaagctgctggagccataaactggtaagaacatctaaatggtgattttgatgactttctgaaagctgagtgtggggtaatgtaagtgataaactacctggggctgcagtcttaaggggcaaacattacaggctttatctccaggaaccccaccatattctcgcagtgaagatctgagaaaagttggccttgtggatctgacactgggaggcaaagataaatcattgtaaaagaaatgcccaagattttccaccttcacctctgaggttatataccccattctggctacaagataggctaacggcacctgagacgctgaagccaaagctgaggaagaaagcaaactccgcaacagttgagttggcctgggcacagtaaatctggagatgactcataccttcagtgaactcgttcacaaaaacacaaatcaacctcttttagaatctcagggttcccgaatactgctgagggccctgtcaagagcgagggcagctaaaagaaagtacatggagcagaggtggggcaggcattgatctgggtgggtgttaatcatgggtagatgagatgatcaagatggcgcccttcctcctataaggccctcttagtccatcaccctggggctcattttgggtgaccctattctcattcagaggctgtttgtcagcctgaagcatttccaaccagaagctccaaatcccattttgatggtggagagtcttcattaagattcttccatgacccaactccccagactagtggtagttcacatgctggaggaaaggccctccaaccagcatcactggtggctccccatccatggaagaaaatcaaggtgaacttgggtttagctgtgacttcttagacacaacaccaaaagcatgactcatgaaagaaaaaatggataacttagacattattaaaattaataactactctctaaaaaacactgttaggaaaatcctgcccataccggtggtagttcatgtgctgatggggaaagcccttcattcctggaggccctctggccactatgtaattagttcaggctcatcccatgatacctgtcttctccacacttagagtacctctgatctcaggaaggagggagacccccttccttgctccattaagtactccaagtcccactagtgggggtctacagcgagggttttctgtcaaggaacaggatctggaggacaccttgcaatgagcaaaaaaggagagaagccaaggccccaaaacccctcttcccaccaatggctctcacccagatgaggaggaggtagcactttactcccatcacatgtggacaacctggcactgcctctaagttgatagagacctcctgggcctggtcagggtgttagcccaacaagccttgtcagaagtctcaggaatcatactgtcaggtcacacttctctgagctccagggctctagagatcagcaggggctgtggtgagagatggaatgaacaaatcactggtccaggcagccttctcctaagcctcctcctgtctagccaccaggtctagctctttgaaaacgaagacccctgagggtgggaaggtcatctgtgttggagacaaggggcagaaggagctgccatttcccccttcctccttgacttgtatcatctccaacccttctggtactgaccaatgtccctagcctctttcagtcctttcccctccagcattatcgatgctctccttgacccatactgcttgctctctagatgatagaaacatatgaaggctcatttttaccattccatgtattttatgtatatttgaaaaaagttacaggaaacctttaaaaagtagttctttaatcctcctggaattaatttttgtgtgtaattccaaggagggttcttgttacattttgttttctacatggatatttagttgtttcactgtcatttattaaaagttatagttttattattgccctatctctcctgctctttttaaatatataaatcaaaagtccatgtattaagtgggtgtgtttcaggaatctctattcagctccattgttctatttgttacaccttgtacccatactacaaattctttatcactagagctttctagtcattcttactatctggtggaggaactccttttatcttcttttatctcaagaatgtcttggccatgcttagcctattgcatgttgtgttaatctgttctcacattgctataaagaaatatttgagactggataatttataaagaaaagaagcttaattggctcacggttctgcaggctgtacaggaaacatgatgctggcatctgctcagcttctggggaggcctcatgaaacaatcatggcagaaggtgaagcggaagcaggtacgtcacatggccagagcaggaataagagagaggcaggggagatgccacacacttttaaacaaccagatctcacgagaactcactcactatcacgataacagcaccaagggggtggcgctaaaccattcatgagaaatccagccccatgatccaatcacttcccaccaggccccacctccaacaatggagattacaattcaaaatgagatttgggtggggacacatatagaaactatatcacatgtcaatttaaatttcagagtcatcttgcaatattttacacacacatgtatgtaagcacacacattcacacataaagactttaatttttaaattgggattgcaatcatctgtacattacttctggaaataattaacatgtctacaatattgaatactcacatccatttattttatatttaaagccttaattagttcattaatttaatttccatgaagttcttaggctttctttggttagattcattttacaaggtatattttgtttattctcattttcatactgttactgcagaaacttaatttttttgtaaattgatatttgtcctgcaacttttatatatattttattaaatgaataatttactcttattttgaattttctttatacacaatctaaaaaccatctgttaattaggcaaattttgtttattttttatctctagccctttgatttcatctgcttagcattactgcactggctagtacctctattacagtattgaatagaaatggtgatagcaagaatcattgtcttttacaatttcaaagtaaaagtaactttcaactttttgatgtttgctgtagttttttggtaaatactctttaagtagtttgctaacagtttttcattgttaatcaacctgtagctttagacttagagaaaaatagaaaacctagtattgagtgccttatgctctacaccgtttcctctattattaacattttccattagtatggtacatttgttacaactattgaacctatattaacacattgctattaaccagagcacatactttattcagatttcctttgtttttacctaatgcatttttttttctgttccagagtttcatgtaggaccatcgtttcacatttactcgtcatgtctccataggctcctcttagctgtggcaggtcttagactttccctacgtttgatgactttgatcttcacagtttcgagtagcattggtcagctattgtgcataaagcccttctactgggatttgtcttatacgtctgtcatgattagaatgagagtatgaacttccagggggaagatctcagaggtaaaatgccattctcttcacatcatgtaaaaggaacctattagaaatatgatttctcatggttgatgtcagcttcggtacaccacttgttctgtaaaggtacagcaatctacaaagtatgatattgccaaaagaatggacacacatcaatggaacaaaatagaaatagatccataaaaatatagtttactgattttttgacaaagatgcaaagataatcctatagagaaatgatagtcttttcaacaaagggcacctgaacaaatggatctcaatatgcaaagaaatgaacctagataaaactttatatctttcacaaaaaataacctcaaagtatattatagactcaaatttaaaatgcaatattataaaacttcttgaagaaaataggggaagatctacatgacctgggttttggtgataaattttttagatacaacatcaaaagggtggtctatgaaaggcaaaattgataagttagactttctaaaaataaaaaagaaacctcgaaagctctttgaaagacattgttaggaaaaagaaaagagaagccacagactatgaccaagtgtttgcaaaacatatatcggatagaagatctgtatccaaaatctacaaaggaggcttacaactgaacaataagaaaacaaatttataaaaactcaatcaatgggcagaaactctgaacagacacatcgccaaagaagatatacagatgggaaataagcataagacaagaccatcaacatcattcttcgttagtgaattgtgaattaaataacaatgagatacacagctattagaatgtctaacaataccacttgctggcaacactaaggagcaacagacactcttactcattgcttctgggaatgcaaactggtacagccactttcaaagatggtttgtcagttttttgtttgtttgtttgttttcaacaaagctgaacacaagtcttgctattcctaggtatgcatccaactagtttgcaaacttgcttccacacaaaaaacttgcatacaagggtgtatggcaacttatttcataattactaaaaactggaaacaaccaggatgttcttcagtaggtgaacggataaacaaactgtggtccaacaataatagaacattattcgtgaaaaaaagaaatgagctatcaagcaacagaaacacatgagcttagcgttaagtgaaagaagcactatagtgaaaagcactgcagtctagttgataagtctgtttcccacaaggatgggggttaacagttctggttctactgtgcatatatatacatacacacacatatacgtatttgtatgtatgtatatatctacccatggatcaactactttatttatttatttttattttttattttatttttttgagatggagtctcgctctgttgctcaggctggagtgcagtcgcacgatctcggctcactgcaagctccgcctcccaggttgacgccattctcctgcctcagcatcccgagtagctgagactacaggcaagctgcaagctgtactacctgcagttgagggaggggtggtacgagcacccgcttggccaccccagttggtatctcactagggtgcatgccccctaagtccactggctctgagcttagcccagcaccaggacttgcccaagaattgtaatccttgtggcctagactgcctttcatttagcaccacggaccactttagtccacagtggtgaggcttgtggaactcaggttctgaccactggttagggctggtctaaatgctccctctgtgggtaccggctgagttatgcctggtgttgctttctgctgtaacagggcagtagtgagttccaacgcaaagtcccacaatcactgccctctctctcccttaaacacacagattctctttccgtgccacacagcaactactgggagatggggcagggatggtgttagcaattcaagactgtctctcctaccatcttcagtgcccctttcagtggtatgaagttagaaccaggtactatgatcattcacctgatttttcattctcattaaagtgcttctttgtgtggatagttgttcaatttgatcttcctgcagggaggacaattggtggaggcttctgtttggccttcttgttctgccttcaagccaaaagaattatttcacattagaaacaattcaattgtaattctgtacatacaagatagagtagaaaaaacatttggtcatttcgatgagtacagaaaaagcctctgaaagaaatactatgtgatttcaaattgacaactttcagcaaactaagatgaaaaggaacttccctttcctaaaattggcagcaaccatatttaaatatgaacttttagaagaagcattcacattcatgtcagacacaagtcgttgacatatgctgtcatggctactgtccatagctgcagtgggtagcaaaaatgcaaaagagtcagagctatggatatcaaaatgaaaaagaggtatgaagattgaaaagaaagataatatttgttgagaatatgattatctatcaagaaaattcaaaggaaaagacacatggaatattcaaataaataagaggcttcagaaaccagcaaatagtagttcactacagcaaaatcaagaggcttgccacacaaaagcaacttagaacatatgaaacagaaaatatagcattcaaaaaagcaataaaatccaaaattaaacagaagcctcacaaaaatatataagatcttcacggaggcaactgtataagtttactgatagattctggaaaaaattttccaaataaatggaggagtgtcataaattcattgatggaaaacagaatactgcaaggatgtcaattctgcttaaattatatacagagctagtgccttacctgtagctgccaaaataacaatcaagttcaggctgctgtgttctgttcccaaaatcaattctggaaaagtatagaatggaaaaagaaaaaaaaaggattagcaataaaatctaaaccacaaaacagagaaatccctggggagactaagactgcattgaactgctacttgtgtttggggcatggggtagtggcagagaagttggggaggtctgtagcctgcgctgacagcacactacagaatgggtagaaggaaaaattattttaaactcccaccccatattattgcctaatatgaggcagcatctcacaatgtgatgccagtagccctggggtaatatcaggacaccaggaatcttggtgtgattgagacatgatggctccagagttctgttaatacccacttgacaccaacttagtaggtgaggcctggccttccaaaaatgtaatttaaatagaatataaagaatgaactagaaatggaatagcatgagtgaatcatacatagtatgagtagatattgtttaatgaaataagtatatgtaatatatgtacatatatatctgtaaagatatatagtgtgaatacataaaattattcatatataacaaacttatatacatacatgtttatgtatctaaacataagcatagtctacatatatgacatataatgtacacatacaattagcagaaatgtaaaatttatttcttactgtgtgaatgcggattaaaatatgcacgtcactaaacagtacaattaaatgtcacaaaaattccaaatgcaggactcctcaattctcttgctgctgctcagcctcttcagtgtaaaaataaatgctttaggacaaaaggtttgacaagtcgacttctggctggggaggagcccccgtgggaaggtgtgtgtcttctcccagaggccactacaatcgcaggcactgcagctccccagggagcacctggcctgggacccgcagccattctctgcaaggggtacagctgggcgaatactcagaggtgacagaaacagagcatcccccacccatcacttcatcaaagagccaggagccaagaggagaaccctcctgagtaaggattgagggtccactcaccccacatagagggaccacagaatccagttcagcccctcctgtcagccctggaagaccctgacaatgttgtcgccccgaccatatccctccctccactgccacctcaggggactcggagtcagtgctttggtctgaggggagcagacaccatccacacaggatgggatccaggctctgccaggcatcaaggtcaggaccttgaggatgactgagagtgcccaccccctcgacctcgaccccccacccccacccccatttccacccccactcatagcagaatccgctatgacaccagcagtcaacccaaggaagccccaggcttggtggccggatgtgacggctagggggtcagagaagcgagggtctcggtctgaggggcggcttgagattggcagagggaagtggacccaggctctgtgagaagacaaggtgagaggctgagggaggactgaggacgcctccaccccagatagaggaccccaaataattcagcgtcacccctgctgccagccctggaccacctaggggagtacttctcagtctgggccaccccccggcgccctgccaacccccgccgcttatgccacaggggactctggagtcagagcttggtgtgaccaaggcaggggtggttaggagaaggcagggcccaggttctgccaggtttcaaggtgaggaccctgaggaacaactgagggcctccctcacccccaagcccaccgtcaccgccacgacctacagcctcaggatccccatccccatccccatcttcacccccatcctcgcccccacccctcctccattcccattcccatccccacccccaccccgacagaatcaggttttgcccctgctgtcaacgcagggaagccccgggtgcccggatgtgatgccactgatttgcgcctcagggatcagagggaagcgagggcctggttttgaggggtggcttaagatcggcggaggaaagcgggcccgggctgtgtgtgaaggaaaggtgaggcgttgagggaggactagggacaccccgttgcaacccaagatagaggaccctaaaaaatccagcaccacccctgctgccaacccaggaccacccgggggcggacttctcaggctgggccgcccccaactctctgccacttaagcctcaggggactctggagtcagaggttggtgtgatcagggcagggctgcctaggagagggcagcagccaggctctgccagccatcacgttcaggaccctcagagagggttgagggctccacagagcggggctctgtccttgctgtcagccctgggaatttccaggcatggtggccaggcatgtggatcctggcatgggcatccagggctgacggagggaaggggcttcatatcatgagcacggattgcggggagcagagggagggcccaggccctgctgggaaacaagggaggcctgagagaggcccgagggcacccaggaccccaggacagggggcccacccaccccctgtttgagactgaggtgcctcctcatttggccttgggaatctgagggatgaagactcaggtcagcaggctggggtggggcccaagcctgccgggagtcaagggcaggaagaagagggaggactgacgggaacttggagtccagatcagtggggacctcgaccctgggaggtcccaggcacagtggccacatgtggcctggactcgctgtgcctttggggtgtcagggaggagaggactgtggtctggggagtggggcctcaggtcagcagagagaggagtcccagagctctgaaggatgactcagaagacctttcttcccagacttaggaaacctgcccctactgtcagtcctgggaggcctgggcaggactgtggggaagggatgctgtcccaccactttctccctgagggtatcagggacatggtggccttggcatacagttcagcaggagggaaagagccgggccctgtcgggactcaatctgaacacctggaagacacccagacagcggagggccccctgaaacttgcaccttctgtcagctttgggaatcccacgcaggggtgaccgtgtggtgccccctcacctctacctcctgggtctcagtgaggtgggggccttggtctgaggggcgtcctccgctcagcagaggtagccacacctggtcagcaccggatagagtccagggtcttccaggagtgaaggggaggaagtttggtaaggactgaaggtaagaagttacctccacatcataaagaagaagggaacttgcagagccgcccagcttcccctgttctcagccctgggaggccacaggcagggatggcatgtggcatgctctcatttctgccatgtggttggaggtgggaggtctcagggaggtgaggaccttggtcccagtgacactgacaggccagtagagggagccacacctggtcagcagagggaggagtcccagcatctgcaggacccacggtgtgcacctttcatgaggactggaggtacccccagcccagaaagaagagaccccgcagagtctgctgtccttgttcttagctctggggggacctgatccagggtggccctaagtggcaatctcacttgtgccacgggcaggaagttggagaaccctcagggagatgtggtcttggtgtaaaggggagatgtctgctcatctcagggggctgagggttgaggaacggcaggtcccggcaggagtaaagatgaataacccacaggagaactttggaacttccaccccagaacagaagggggcagcccctggtgtcagccctggacaccccatggaggggtgacgggatgtgagtcctcctcatgtcggctttgggatctcagggaggtgaggacctagttctcagtgggttactcaggccaacacagggacccccatctgattaacagacagagcggacccaggatctgctaagaccccaggtgaggaacctgagggaggattaagggtaccgctggaccagaaggcagatggaggccccacagaaatctgccttgcccctgctgtttccgcagagagcatggccagagctgtcagttgaggccccctctcttataccaggatcagtggtctcagggagggggaggccttggttggaggggctgcatttaggtcagagggagggtcccaggctcagccaggagtcaaggtgaggactaagtggaccccacacggcgaatgcacatgacccagccctgccctgccttttctgtcaggcatgggaaactgcagggaacagtgggtggatggaatcccctcacttcctttactggtgtctcttggagatagggatttgatttaaggtggtggcctcaggtaaacagggagagtcccaggatctgcaggcatcaagatgtggaccaagcaggttcctcatctcaggacacatggacccagctgaatatggccacctcttactgtccttgcctggaagccctgagcaggtgtggccagatgtgggtcccctcatgtccttctgttccatatcagggatatgagctcttgatctgagagtttctcaggccagcaaaggggcaggattcaggccctgctaggagaaacgtgaaggtcctgagtgagcatagaaggggccatctatgcaaaagagtgagggaactgacagagtccagcccaccctcctgacagcactcgggggactgaggctgtgcttgcagcctgcaccctgagggccccttgatccctcttccaggagctccaggaacttggaggtgaggctttagtctgagtcagtgtcctcaagccacagagcagaggagacccaggcagtgccagcagtcaaggtgaggtgttcaccctgaatgtataccaagggtcccacccacccataatggatgggaccccagagcgcccagccccacctgccctaccctcagccttggggccttggcctctgctggctggctgtaacctgagaagctgtgtcacttctttcttcagattctcaggggacaggctgaccaggaggacaggagccccaggaggccccagaggagcactgaaggagaagatccgtaagtaggcctttgttagagcctcctccaaagtctggttcttagctgaggcctctcacacgctccctctctccccaggcctgtgcatccccattacccagctcctgcccacactcccgcttgctgccttgaccagagtcatcatgcctcttggacagaggagtcagcactacatgcctgaggaaggccttgaggcccaaggagaggtccctggcctggtgggtgggcagggtcctgtgcctgaggaggaggaggctgcctcttcctcctctagtctgatcatgggcaccctggaggagttgtgtgctgctgaggcactgagtcctccccagagtatgcagggagcctcctcctcccccactaccatcgataacactctatggaaccaatccgatgagggctccagcagccaagaaaaggaggagccaatcaccttgcccatcccaagtgtcatggagtccttcctccgagaggcactctgacaaggtgtctgatttagttagtgtcctgctccacaagtttcgaattaaggagtcagtcacaaaggcagaaatggtggatagtgtcatcaaaaatcacgaagactacttcgctttcattttcaaggaatcctccgagtacatgcagctgatctttggcatcgacgtgaaggaagtggtccccaccggccattcctatgtccttgtcacctctctgggcctctcctatgatggcatgctggttgatgacccgagcaagcccaagacgggcctcctaataattgtcctgtgtgtgatcttcacggagggcaactgcgccccagaggaggttatgtgggaagccctgaatgtgatagaggtgtatgctgggagggagcacttcatctatggggagcccaggaagctgctcacccgggattgggtgcaggaaaattacctggagtactggcaggtgcccagaagtgatcctgcatgctatgaggaagagagagtttcagcaggcgatgcagccagggccagtggagggtggggtggactagtgcacgttccagggctacatccagcagcttccccaccctgtgtgacatgaggcccattcttcactctaaagagagcagtcagcgttctcactagtgaaaggcacggtgggtggaagggaactcagtgtataatgtctttgtgttctgttctatttggatgagtttgctattttgtaaaacatattgggaagcccttcatctggttttgcggtttggaacaagatgccatggcattggaataggtgtttccttggaaaatgaaatacattagcaaaaaaattgatggggtcatgaaacagagaaataaaaggaaaagataggctgctctgcccgtagagtagctattcttttatttactttcttaataaacttgctctcactttactctatggattcacctcgaattctttcttgcacgagctccaagaaccctcttttggagtctgcactgggaccccattccagtaacatctttccggtgaaccctgaagggacaatactgaggaaaccccctgacccaaaggaaatagacggcagcactgactggcagactttggagtcaggaaaacttttcttctgggctattgacagcttttaacaattcagtaaagtatacttctgtgaacaaaattcagagcatatttgtttctctctacctaatttctctagaatttggaaactgcttgtgaatattcttaacttatagcaatatagttatttgcataagtgcaataagaatctgttttcttttgcaacaagacacaattggagaaactggttattttaccaaggctttgactggaatggtgttctttcctttaagggatcaaacttgacttatagagccaataaaaaccccttgggaaaactagcctcataacttgtctacacagtccctgtgcagggttactgacctgtggtaagtaaagaatgtcattatctgacaggcccaggagccccaagttatcttgggacctcaagaggagaggattttacccaactcagaggtatttgacggcacccaccccaggctggactcagctttaaaaaggtcttatctgagattccttctatggaacagagctccatgaaagccatttatttttattttttattttcatttatttatttatttatttatttatttatttatttatttatttatttattttcgagaccgagttttgctcttgctgcccaggctggagtgcaggagggtgatcttggctcactgcaacctccgcctcctgggttcaagcgattctcttgcctcagcctcccgagtagctgggattacaggcacccaccactacgcccggctaatcttatatatatatatatatatatatatatatatatatacacacacacacacacacacatatatatatatacacatatatatgtgtatatatgtgtgtgtgtgtgtctgtgtgtgtgtgtgtgtgtgtgtgtgtgtatatatatatatataattttttttttcttttagtagagatggggtttcaacatgttggcctggctggtcttgaactcctgacctcaggtgatccgcccacctcagcctcccaaagtgctgggattacaggcgtgagccaccatgcccggcccatcaaagccagttttaaaagagcttatgtgaggctgggcgtggtggctcatgcctgcagtcccagcactttgggaggctgaggcaggaggactgcttgagcccaggagttcgagaccagactgggcaacattgggagactgcctcctattaaaacataaaataaaaataaaaatataaagagcgtatgtgaaaaataattattcttgctgcactttatacaaatgatcaggccaagtataataaaacaaaccagtcttaccatgatttgtctttagtaaaaatgggagactggagagagaaaaaaatatgatgttgcaaaaactatggtgcacctgttattagattctagtttcattcgttgttttaaagtttttttctgcaatttagactcacttttcttattcctgtgaaccaatcagtgatccctgactgctatttagaagaagcaagagggatgggtaatgtaaaaatctggatcaatattctagttctgggcacatattgaaatcagatagtgaccccgtatcagcctggttctaacagttgcccagttcaaggaaagccttcttacttagtttaccttgggataattttacttattttgctttactgttgtggaatacactggtgttgtattcttggtgcaggagtgcaggataagcttactcaatgttttcttaaactgaacacttattaatcttccagataacatgttttgtcagaactcagagttgtgtatgaccctcaccaaactgacgctttctgactgagctcctctctgtcctgaattcaaaagactctcataattaggcagtaatatcatcacccctattcagcctgaagaagttacagaagatggatcttcatccctctacaacccttaggaataaaggttctcagataaaagggaggagggaaatgtcagaggtgtttgaaccagagcaactccatcttgaacagggtctgggtaaaatagggctgagacctactgggctacattcccaggaggtaaggcattcttagtcacaggatgagacagtatgtcggcacaagatacaggtcataaagaccttgctgataaaacgggttgcagtaaagaagccagccaaaacccaccaaagccaagatggcaatgagagtgacctctggtcatcctcactgctcattatatgcattagcatgctaaaagacactcccaccggcaccacgacagtttacagatgccatggcaacgtttggaagttaccctatatggctgaaaaaggggaggagccctcagttccaagaattccccacttttttcctggaaaactcatgaatagtccaccccttgtttagcatataatcaagaaataaccataaaaatgggcaaccagccgggcgccatggctcacgcctgtaatcccagcactttgggaggccaaagggggtggatcacgaggtcaggagatcgacagcatcctggctaccacagtgaaactctgtctctactaaaaatacaaaaaatttgccgggcatggtggcaggcacctgcagtccagctacttgggagaatggggcaggagaatggcatgaaccagggaggcggagcttgcagtgagccgagatcacgccactgcactgcagcctgggcgacagagtgagactctgtctcaaaaaaaaaataaaaataaaaataaaaataaaaataagaaggcgaccagcagccctcagggctatggagtagccattcttttatttctttactttcttaataaacttgctctcactttactctaaaaaatagaaataaaaggaaaagacagttaattctcagctttttattcatgtgctgttctataaaattaagccatatatgtgtacctggattttcttggcttattcaaggatgtaggagaaattatatcttaaatggaagtcctggtcactggctcattctttctcaaacactcactgagcatctgctctttggaaagcactgtgttactggagatactggcataagtcagacccacccctacccgaagggtggtagggtctaggagctatagtcataaaattaagttggtgagatttcctctaagacctagaggaaaagtaagagagggcagaatgtgtggtgctcccggtgagagtggtggagtgtaaatgccctgagccagggccttttgggctttgggaaactgcagttccttcggaggaagctgattctaatgaagctggtgggtccagggtcagattctcagggagagaaaagcctggaatggaaaactgctctgagcagttcattatggttggtggatgaacatagacgagtttccacctggggcaggaatggaaggcatcctgtgctcttatcccagtgcggttgaatacagcccaagagctaggtgatggatactcatcatctgcaagggtttcctgggaggtaagggtgaatctctcaggaagggaggcccagaagccactggcaaggtactcttctgccttagtgggagagctagagctgactctagtcaaatggcattctaattaggttatctcaagtgtaatttggccattcctgagcatgggctagattttgcgtggtgattatatgaatgaaaatagtggttgagatggaaaagcagctgagagggaggaaaagagttggtcctggactcacgttccaggaacactgagctgcaatccagctgaagaagactcctccacacacaaattaaacaatagatcctctaggagggaaattctactgtgttttgtctatgaagcaacactttgggctgagttggtattctattctctgtactgttgtgctacgtactctgaggtttcctagataacaataacaacagcaacaacaaaattcccagaggcaactatggtaggatctgagttccaaatagtaacacaaataactgccaaacattaacgatctaatatatgccaggccctgagccaagtgctttacttacattgcacacactccaaaagtcctataagacagactttatcaaacctgcttcacagatgaagaacctgatgctcatgcggcttgatgatttccccataattacatggctaataagcaacacggttgggattgcatccctgctagattaggatgggccccaatccaatatgactggtgtccttataagaagaggacattaggacacagacacacacagaggaaagaccatgtgaagacacaggaagagaatggccatctacaagtcaaggagacaggcctcaggacaactcaaccctgcccacaccttgagcctgaacttgtagcctccgggactgggaaaatacatttctgacgcttaagctcccccagtctgtggtaccttgttatgatagccaaagcaaactaatacacatggtccgaattcatctgagtgtatgtcattccttcgcgtcccaacctgaagcagaccttcgtcttgctatttacttctcaggaatccacgtctctcaggcaaccaaaagaaggaccctgtggtcaagctacaaaaagtatgcctaaagaagtgctatggactgaaatgtgctcccctccaaaaaaaaaaaaaaatgtatatgttgaagctctaagtcccaatgtgatggtctggagatggggcctttgggaggtaattagggttagatgagctcctgagagcgtaggccctcatgattggattaatgtctgtattcgttcattcttgcgttgctataaaaaaatacctgagactgggtaatttattaaaaaaaaataggtttaattggcttacggtttgcaggatgtacaggaagcgtggcagcatctgcttctggagaggccttagggagcttttacttatggcagtaggcaaagaaggagcaggctcttcacttggtgaaagcaggagcaagagagacggggggggcattgccacacactattatatgaccgtatgtcgtgagaaatcactcactatcatgagcacagtaccaaggtgatggtactaaactattaatgagaaatctgcccccatgatccaatcacctcccaccaggccccacctccaacactgtggattacaattcagcgtgagatttggtggggacactgatccagaccatatcagtgtccttataggaagaaatgccagagagcttgcacatttttctctttctctctctgccatgtgaggactcacagagaaggtgggcatccataagccagaaagaagaccctcaccagacacccaccatactggcattctgacttttggcttcccagcctccagaactgggagaaaataagcatctgttgtgtaagacccccagtctatagcattttgttacagcagcatgaaatgactaagacaagaaggaaggtgacaatgagaaccaacacaatttaggaatcgtctgtggttccttgagagccaactctgtccaggtgccagcatttctgtgcattcccagcactttcccgaattatagcacccttccacaatggtcttgccccatgtgcctgcctgtccaattctggaatcgagcttgctgctaagctcttcatggttgcatcctttaaaggctgtgccctacttccagtgggacagccaagagtcacctgcccttctcctaacatagaacagttctactttctggagaagtcccctgactgtccctgttcctcacactggggcccctctaatagcaaaaatacatttgactttgaatagagaccttcagacatctgatcatcctgttggatgtcttcaacacattcttaaaatgttttccaagtcagctggtgagtagcgtctgattttgacttataatatatcagttcctgggatacaaccctgaagttagaaagtgtttgaaaccatcctatatttacaataggactttaataagctgtctcattggaaactggccacagagcacatacatagatggtcaaaagccaaagcctcttgtattagctcaggctgccataacaaagtaccataacaaagtaccactgggtggcttaaacaaataggtagatgtttctcgcatttctggaggctgggaagtttgagatcaaggttctagcaggtttgatgcctggtgagggtctcttcctggcttgtagacagctaccttctctgtgtgtctgcacatggcagaaggagagaatgcgagcaagctctctgatgtctcttataagagcggtaatcccatcacgaaggttccaccttaatgacctcatctaactctaattacgtccaaaggcctcatctacagatacatcacactgggtcttagggtttcaacatacgagttttggtgggggtgggggcacagttcagttcacagcatctccttcataagtgacagatgaggaaggactgtcaaaatcactgtggggcaaatatctactgaagctgaattcctaaaaccctaaagttctcctaggagacgaaaagtggttcctcggtaggcatgctagctctgattagaaatggaaaaaaaatcagaaatgaaaaaaagaactctcttggcactacttctggtctgtggatctgccccacaggaaagacatagctttcaatgtgtctaatggcatctgaacagacgttcaggtaacaggagggtagcagagacccacaggttgaggttttacccatgaattaaaagaatgagaaattctcagcctactaaggtttcagacattattgcaaatgacagtgcagaaaagtgttagtaagtgaagatagttagtatatctaactatactagtgagtgaagaagttagtatatcacacgaggtgctgaggtatactggatccttagaaaactacatgtgatcctgtatttgaaagcatctgtcatacagtacacacttaaaaaaagttggagaacgtaaagaaaatctggttttctccgaaactcctcccagcaatgaagagggctgttgtcatagcaaataataatagttcctttttgttgagcacctactatgcaacagtttatgggagagactatagtgctcacccacatctcatcttcctctctttcctggatacatgggaacagtacagtccacttgtagttaggaagggtcatgtgacaaccccttaccactgaaacatgagcagaagcattgtttgtcacatctagacatctgagagccagtgtgccatttccatgctttctccctccatctaatagtaaacatggcagcctcatgttgaggtggtggaatcccgaggtggaagctgcctggatacctgggtcacgggagagtggagaggccctgtcaaaccacatcaggactcatgtgcacattaaataaacttgtgttttgtcatgtcactcaaattccagggtttgcctattgcatcagctagcagttacttcagttactttaactgactaatacacagctactatttttgctgttaggcttatttagatattgtaatttaaaagataattgtgcctatattcttgttgcaaaagaaatctaaaatacagataattcacaattcttctctgtataaagttcctccacaattcagcccgcacctcagaggtcaccacaatcagcaacctgctgtgtactattttattgtatatttttattcttttctgttttagtttgtttttgaatgcatttatttcacaaatatgttcattaggtgctataaaaatgtttgtatcaccttttgtgtttgtataaattaaatcaacaataatttcggtcaaaattagtagtcccgagaatttttctcctttatacagggtgcatatccgggggccttcaaaaagctcatgaaaaaaaattgaattaaaagataaaaataaaaaatatgaaccaatttctgaacataaactatatcaagttcaagacacttttgtaagtgacgataccagatatttagtccattcctaaagaactgagagtcctgggaatttaaccacgtcagtgcagtccttttacattattaactgaagaaaactgagtgtcctttgacaacttctcaagatttggactgtgggcttttgcgttaacgctgaaatgagttaagactttgggggactgttgggaaggcaggattggttttgaaaggtgaagacatgagatttgggaggggccacatgtggaatgatattgtttggctctgtgtccccacacaaatctcatcttgtagctcccaatattcccacatgttgtgggagggacccagtgggagataattgaatcatggggttgggtctttcccatactgttctcgtgatagtgaataagtctcaagagatctgatggttttaaaaacggcagtttccctgtacaagctctctctctctttgtctgccgccatccatgtaagacgtgacttgctcctccttgccttccaccatgattgtgaggcctacccagccacgtggaactgcaagtccaataaacatctttcttttgtaacattcccagtctctggtatgctttatcagctgtgtgaaaaggaataaatacagaggggttcccctacttcatttgaaggtttattaactaacaataatcagtatagtgtggaattgtcctaaatttagaaacacataaaaagaagagagtaaagtccaggaatggatccacatgtatatgcatatatatataagtcaaatattgataaagatacaaatgaagattcgaggagagaaatgatagtgtattcaactgggtctagaacaactggatatctatatgcaaaactgaatttcaatccgtaattgctttcttcctgtctatctatctatctagctacctacctacatatctatctatgtaaaaagggagggagagaaagaaagataaaggtttcataaggaattatctcatgtgattatgaggtcttgtatatcccaaatctgtgaggcaggccagcaggctagaaactcacacaacatttttatgttagtcttgcggtagaattccttttccaggaaaccttagtcttttctcttaacaccttcaactaactggatgaggcccatccacattatggagattaaactgcttcccttaaagtcaactgatggtaaatgtcaatcacaactacaaaataccttcacaacaacatctagactactgtttgaccacacggctgagcactatagcctagacaagttgacacataatattaaccatcgcacatatcttacaccatacaaaaatgtaactcaaaatgaaccacagacttaaatgtcaaaattatgggtttttttttttctgtaggagaaaacaaaaaaaaattgtgttacctgaggttatgtcttagtaagctcaggctgccctaacaaaatgccatggactgagtagctgaaacaaaacaaatttattttttttcacagttttgaagtatggaagtcccagatcaaggactggcagggttggtttctggtgacggccttattcctggcttgtagatagccctttctcaatatatccgttcttggcctttcctctgtgcatgtgcagagagagagagagagagagagctagtgcaggcacacaagtaatttcttctgtctcttctaactgcttataaccatactaatcctatgggatcgaggccccacccttatgacctcttttaatattaattacttccttagaggcctcatctccaaatgcagacaccccggggctgagggcttcaaagtatgaatttggtggaggacataagcattagcaaagaatgcacacatagattaataaaacagaatagagctcagaaatagacctgcacacttatagtcaggtgattcacaacaaaggcaataatggtgaaagtacagtttttccagcaaaaggtgcctgaacaattagacatctacaggcaaattataataacctagaaacatccttacatattccagaaaaattaactcgatataaatcacagacctaatgcaaaatgcaaaaactatacaaccctctataagaaaacataagagaaaattcacataactttgagttcagtggtgagtttttaaattcaacaccaaaagcatgatcaatgaaagaaaaatttaccaagtagattttattaaaataaacatcatgtgctcttcaaaggacaatgttaagagaatgaaaacagaagccacagactagcagaaaacatcggtggtacacatatgtgataaagaacatatctctacaacatacacgaattcttaaagttcaacgacagaaaaaacatgaaaataggcaaagatctgaacacactcctcacaaaagaagatatacacatggcaaataagcataaaaaagtactgagaatccgttctcattagataactgtgtactaaaatgagataccactacacacctattagaatgtccaaaatccataaaaaagcaaaaaaaaaaaaaaaaaagaaaagaaaaccaagatcaattgccagggaagatgtggagcaacagaaactctcattcattgctggtggaaatgcaacatggtacagccactttggaagacaatttggcgttttcttaaaaaactgaacacagcataagattcagcagtcataatcaatttacccaattgacgtgaaaacttacgtctacataaaaatttgtatacgattgtatacaaaagattatttcataatcaccaaaaatagaagcatccaaaatgtatttcatttggtggatggatatatatatacacacgcactatggtacaaccagacaatgatactactactcctcaatgaaaaggaataagttctgagccacacaaagttatacatgactcttcagttcattatgctaggtgaaagaaaccagtctaaaaaggctacatagtatgcgagtctatttatatgacattcaggaaaaggcaaaattataaagatgaaacacctatcagtggcagccaagggggttatctgacaagcacaggggatttatcagggcagtgaaactagtatggtaatactgtaatggtggatgcatgcttgctttcatctgaatatttgtgttcccacaaacttcatctgctgaaataccaaggtgatggtattaggtagaaggtggggtatttggagaatgactagttcatgagagcagagtcctcatgaatgggatcagtgtttttataaaatagactccacagagatcccttgccccttcttccatgtgaggacataggggaaaggcaactgtctatgaactagggagcaggtctccatcagacatgaaatctgccagcaccttgatcttggacttcccaacctctagaatgtgagaaataaagttgtgttgtttataagccacccagtctacactatttttgttatggaagcccaaagggactaagacaacggcacgaggcatttgtcaaaacccatagatctttacagcacaaagagtgaagcttaatgtatgtaaagtctaaaagtaacttaagaagttggagaatcatgggacagaatgtagaatgttacacacacacacaaacctagctgtattatacatgtatgaaaccactacagtgaagcaagtggcgggaaagttaccatatttgggtactccatcaaagaaatatgttttttataaagtataagtcggccagataagcatgtaaaatagttgaatatttgataatcatttatataatttttcagatatgaaaactattgggattctgtttaataaaacgtccttatcttttaaaaatgcatattgagttatttcgagatgaaatggtctaatgccttagattcgctccacgttattccagaagctgatgtgcaggtaggcaagtgtctaactggaaccagatttgctgtgtatttaaagttgttcatgctgggtatctagtatcctgggttcattacattagttcctattattctgtacgtgtgaaggctttccctagtaaaactttttttataataaatatgccattaaaagtgaaatcctaaatgaaactgaccactttgtagaaataaaataaaccagtaaccaaactgatccaaaaagaaaaagaaaactttaattaaactataaaaactgaaactgtacaatattcaaagctcaagccaccttcaaacattccaggttaggcagtattggaggccaattctaccaaatgatcagggaaaactaaccaccatcttatctcatctcttctagaacatacaaaatatttacaattgttcaattcattcttccagactagccctcctggattcaaaaaccagatgaggaccacatcccacccttgatgggaaaaaaagcacacattaagtaagctcccttacatagcagcaaatatcctacgtaaattactagcatattaaataaacaggctctgcccaaggaaataacatacggtttaacattaggggaaaaaaaaaaaacggtttcattgtaattccttacatacaaaatggaggagaaaaaaatttgattgtgtcaacgggtacagaaaaagctttttaaagaaatttaatatgagttcatggtaaaaaaaaaaaaaagtatttaacctatattcaaagagaaattgcacttcctaaaatcaacagcaaacatacttaaatgcaaaacgttcgaataattatcattcacgtcaggaacgagaagtagatgtaggctattatctctacgattgaaatcaggattgagacacaaagagctataagtaccaaaatgagtaagtggtatgaatactggaagaatatgtaatgtttagtgataataccattatcgatcttgaaaattcaaaggaaaaggtatgtggaatattcaagtgcatcggccttcagaacgaggagtgcaacagattactacagcaaaatcaaaatcttcacctcacgaaagcaataactaactacaacaattaatagacaatatgccatttgcaatagcaacaaaattcatgaattgcctgaaaagaagtctaataaaaatgtataaggtctttatagagacaactgtcgaagtatactgacatattcaggtaaaaaaaagcttgaaatacatagaggagtataatatattcattcatggggagcacaacactgtaaaaatgtaaactcagcttaaattatttacaatttagtgccttacctgtagccgccgccattacaacaaatttgggctgctgtgctctgcttcccaaatcaaacctggaaaattacagaatggaaacagtaaataaaaaaccagtatcagcaacaaaatctacgcaacaaaacagggaaagcccagggtgagactcaaggctgtgttgagctggtacttgtgtttgacacttgcagtgttggttggagggggttagcagcagggatgttggggaggtttgtagccggcctacacggtagatgacagaatgggtagaataaaagtttgaaattttccacttcacttctttgcacaatctgaggcagcctctgaaaacacgatgccaagagccctaggtaatagcaggacaccaggaaaatttggttggttaaggcagtatgactccagagttctgctaataacaacctgaaaccaccatagtggcagaggaattacattttttaaaaaaaaaaattctttcaacagaacacaaagactgaaataggaggtcactacaaccgcgggagctgccgccccgccctgcagggagcacctggcctgggacccgcaggcattctctacaaggggtgcagctgtgcaaatgctcacaggtgacagaaacagagcatctcctgcccatcacttcatccaacagccagaggtgacgaagacgaccctcctgagtgaggactgagggtccacaccgcccccccaccccacacaccatagagggaccacagaatccagctcagcccctcttgtcagccctggtaaacgcaggcagtgatgtcacccagaccacaccccttcccccaatgccacttcagggggactcagagtcagagacttggtctgaggggagcagaagcaatctgcagaggatggcggtccaggctcagccaggcatcaacttcaggaccctgagggatgaccgaaggccccgcccacccacccccaactcccccgaccccaccaggatctacagcctcaggacccccgtcccaatccttaccccttgccccatcaccatcttcatgcttacctccacccccatccgatccccatccaggcagaatccagttccacccctgcccggaacccagggtagtaccgttgccaggatgtgacgccactgacttgcgcattggaggtcagaagaccgcgagattctcgccctgagcaacgagcgacggcctgacgtcggcggagggaagccggcccaggctcggtgaggaggcaaggtaagacgctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccgtcccccaacaccaaccccacccccatcccccattcccatccccacccccacccctatcctggcagaatccgggctttgcccctggtatcaagtcacggaagctccgggaatggcggccaggcacgtgagtcctgaggttcacatctacggctaagggagggaaggggttcggtatcgcgagtatggccgttgggaggcagcgaaagggcccaggccctcctggaagacagtggagtcctgaggggacccagcatgccaggacagggggcccactgtacccctgtctcaaaccgaggcaccttttcattcggctacgggaatcctagggatgcagacccacttcagcagggggttggggcccagccctgcgaggagtcatggggaggaagaagagggaggactgaggggaccttggagtccagatcagtggcaaccttgggctgggggatgctgggcacagtggccaaatgtgctctgtgctcattgcgccttcagggtgaccagagagttgagggctgtggtctgaagagtgggacttcaggtcagcagagggaggaatcccaggatctgcagggcccaaggtgtacccccaaggggcccctatgtggtggacagatgcagtggtcctaggatctgccaagcatccaggtgaagagactgagggaggattgagggtacccctgggacagaatgcggactgggggccccataaaaatctgccctgctcctgctgttacctcagagagcctgggcagggctgtcagctgaggtccctccattatcctaggatcactgatgtcagggaaggggaagccttggtctgagggggctgcactcagggcagtagagggaggctctcagaccctactaggagtggaggtgaggaccaagcagtctcctcacccagggtacatggacttcaataaatttggacatctctcgttgtcctttccgggaggacctgggaatgtatggccagatgtgggtcccctcatgtttttctgtaccatatcaggtatgtgagttcttgacatgagagattctcaggccagcagaagggagggattaggccctataaggagaaaggtgagggccctgagtgagcacagaggggatcctccaccccagtagagtggggacctcacagagtctggccaaccctcctgacagttctgggaatccgtggctgcgtttgctgtctgcacattgggggcccgtggattcctctcccaggaatcaggagctccaggaacaaggcagtgaggacttggtctgaggcagtgtcctcaggtcacagagtagagggggctcagatagtgccaacggtgaaggtttgccttggattcaaaccaagggccccacctgccccagaacacatggactccagagcgcctggcctcaccctcaatactttcagtcctgcagcctcagcatgcgctggccggatgtaccctgaggtgccctctcacttcctccttcaggttctgaggggacaggctgacctggaggaccagaggcccccggaggagcactgaaggagaagatctgtaagtaagcctttgttagagcctccaaggttccattcagtactcagctgaggtctctcacatgctccctctctccccaggccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttcactggctcgtttcttttccgttcactcagcatctgctctgtgggaggccctgggttagtagtggggatgctaaggtaagccagactcacgcctacccatagggctgtagagcctaggacctgcagtcatataattaaggtggtgagaagtcctgtaagatgtagaggaaatgtaagagaggggtgagggtgtggcgctccgggtgagagtagtggagtgtcagtgccctgagctggggcattttgggctttgggaaacttcagttccttctgaaggagctgactctaatgaagttgggtgggcccagagccagattctcagagtgtgggagaaaagcctggaatggaaagcaactctgagcagtttctttcgaatgggggatgaacagagaggaatctctacctcaggcaggaatggaaggtgtcgtctgcttttgtcccactgctgttgaacgcagcccaagatctaggtgatggacacccatcatctgcaagggtttcctgagcgataaggctgaatttcccaggaagggtggcccagaagcccctggccaggtgcttttctgccgggcagggagagccagagctgactccattaaaaaaggcattccaactaggttatctcaagtgcaatttgaccaattgtaagcacgggctagattttggatggtaacaaaatggatgaaaatggtggtttgggtgggaaagcagctgggagagagagaagcagttggtcttttgacgcagattgtaggagctccgagctgcacctggctgggcgaaactcctgcacacccaaattttgaagcgcgttctctgagaggaaatacttaactgaattttatggaagaagcttctgtttggggctaattattccatgtcctattgagctgtatattctctggtaagtcctggagaacaacgacagcaacaacaaaatcccggagtgttagggcctcgggttaaaaaatattggaaataacagccatccgccatttgttaaacttctaatttataccaggcccggagtcaggtgcttcacctgcgttgcatacactccaactgtcctactagacagtccttatcacatctgcttacagatgaagaatccaaggctcacagggtgtgtgaattgggatataaaaacagggtatttcctgggtatttcccaggatcacgtggctagtgaggaacagggcagaacccgacccctgttctgaattcctttagagcccatgctgttcccacttctcccagcccgaggctgacctcctgacagcgacttcatttttcttctcagcactgcaccatgtctctcaggtgacaaaaagaaggacctcgaggccagcgtaataaagcaggcctggagaacgcgacaatgagaatcaaacaccatttggggctggtgtgcgctgggttccctgagagctgacactggcaagatgtgttcatttctgtccagccccagcactttcagaattacagcacatttccccgggtcacttccatgtgtcctgtctgactccggaacctatagggcctgctgatcagctcctcactggtccccacagaacagcccagaatcccctgctcacctcctgacagggagcattccttctcacagtagaagtcctctggctgtcccgtctctcacccaggaagccatatgacatcaacaatccttttgatataaaaattcacatggggacagtgacgtttagacacctggttaccactccggttgtcttcaatacactctctaattgttttctgaaagggctgagtagtctgtttctccatattatctaagggttcttgtgtgatgtcaccctgaagtgagaggaatttggaaccaccttgatacctgaaatcagactttcacagggcgtccttttggaattcgcctctgaatacatgcacagataaatggtcaaagagcaaaccatccctcatgagtactagatgagaaaaaccttgggaaatcccagtggaacaaacatctacttactgaggctgaattcctaaatttctggagtcctccaggagtctaaaaacgattccttgaaaacatgtcaactctaatgaaagaggaataattaagcagccttctgtttcttgtctgtttacctgctccacgggaaaatactgggctttattgtgcctacaggcactcgagaggtgttcaggcttgtggagggtagcagaaattcacaggttaacattttgaccgggaatcaaatggaggaaaaatgctcagcctactaaggattaaagggtattgcaaagggaagccttctcgccgagactttcaagattcttgggcagttagttgtgatcgtatatttgaaaacatcagttacatatttgacactggaaaaagttggagaatgtcacggcaaatttggccttctcagaaactcctcctagaaatgagaagggtagtgtaataccaaagaatcacagttgtttttgttgagcacctactatgtaacagtttatgggggagggtatagtactcacacacattttgtctctgtctccttcctggacacatgggaacagtaaagtccttgcagttaggatgggtcatgtgacatttcctttataccaatataggagcagaagcattgtttgtcacatccaggcatgtgggagccagtgtgccatttccaagctttctctccgctttcactagcaaacatggcagcttcatcttgagatgacggaatcacaaggtggaagcagcttggattcctgggtcccgtgagagtggagagcccctggcaaactgcatcagaacttatttgcacataaaataaacttgtgttgtggcaagccattcgtggttgttctgttgcaatggctagcagttacttaaactgacatggctagtatttctgtttgtcaggtttaatttttttttatttaaaatgtagtattgtacatattcttattgcaaaacttatagaaatgtagataattcacaattttcccctttacaaatctcctccacatttaacaacgcccaccacccccaccgccccctcagaggtcaccacaattaacggtgttgtatattattttactgctgactctaggcttctcactgacagataaactataacaatatgttgtttttatttaatatacaagaacaatgatatacatactgatattcttttatcactttataaaatggatgtaggatctttccacaacggtagatagatagatagatagatagatctttctcacttttgaaaccactttctataattctaaagtagacatgcaccacaattaattaaactctttcttcctagtggacatataagttgtttcccatttgctgtatgataactacaataaaatcaacatctctgaatatgaatttttaggcaaacatggttttcttataagaaggatatattaacatggacactgggttaaagtgaaagggtgaaaatagtttaacatttaaaatatttctaaaatgttattacaaaagtgctgtaccaattcaaattctcataaaaatcacaattgatttaaaattctgaaatgtggacaggacatttcttctctgctttgagaaggatttggtgagactgaagaggagccaggtaatgagagcagacaggagaccctcagcccgtgagggaggatccagggaggatcctggggagagccgttgctagcgtccatgagagagaccacatgcgaaaccaagtccacagagccccaggcaggctgtcactccgagctctaaatccagacttcaggccggtggggtcaggggcctgagggagagaagggggaagggaggagggaggacaggacaatgaataggaatagagttgggaaatcccggcaacatcatcaccagctggagggggccctgtgatctgagtgttggctgaatgcaccagggctgtgctggtcaaccttcccgccctcagaatccccttccctctctcaggaagagcttggctgactccctgcgtcattctgggccagctacctctcttgaacactccagtggtcctttgtaccttcaccagcgtcccagatgtgggaactgtcttcatgcctgctgggggctggtgttttatcccccggggaccttctatagaggctgggctatgtgagtgggttgctgactgatgaccaactgccgagacaggccaggaatgcccatgagcagttgaaaggggcagtggggctgcatggaggagaaatgggaggaggagtgccctgggactagtcagctcagactctgcagatgaaggattggctgtggacgtgccttgaaaatgttccagttggccactgtgtctcagatagccttctgtggcttctgaacccttggcacagaacgggacaggagtcctagggcagtgaccgctggcgtatgttgccagatgacagtgtctggggtagggggctggaccaaggtgtgtacgtgagcaggttgtatggcaaggcattgcaggtggcagctttccttgttaaactgatggggacgtgtggggtccaatacaggaagcatcctgttgggagcatcctcacctccatgacagtgtttgggcctggggagaaggcgtctgcagtgaccctctccgtggtagtttccacagggtttctgaactcaactgagcacaggtgaaggaactgtgggtttcttcatgtaggcaggaggcccaggaagggcagactccataatttgaatcaaagaattcccatgccaggtgatttcattcattccatgcacgtattgattcctacagaaaacttttattcaatatatgctgaggaaacaccaagtcaacaaaacaatagaaagtggcaaggcccttaattcagtctgtagggagtcgggggagatgaagaggtggtgtgaatcgcccatctgagccagggaagccaggaaggcagagccagacttggggactggcagtgtgcaagaaaaggagcgacagcctgtgtccgggccagaaagctctccttctattacactatcgatctggttttcttcctggatgctgcctgtgtgtgaaagcaactgctgctctctgtgcctacctgcctctgttagtagggaaaatggtcatggtcagcggatgctcacttctgctcaccttggatcacttctactgaagggatggtttgacaacaagaagacaggaagaaacttttggggaggatgaatatatttttcaccttcactgtggttgtggtttcatgggactaaacatttctcaaaactctttgatttgtttctcagtacttaggagaaaaagtaagcagaaaaccaggaaggatatagatgacctgaaaagcaccattaactactctgactaaataaaacaataagaaaagcaccgcattcaacaatagcagaataaacaatcctctcaagtgtgcatgaaatatctcccaagatagatggtattctgggccatcaaacaaagcttacaaattgaaaagaatagaaataatagatagcctcttcttaggccataatataattaaactcaaaaccaaacaccaagatatctgaaaaatgcccaaatattggaaattttaaaataagctcctatataacctatgggtcaaagagggagtcccaggagaattttaaaaatacattaagttgaatgaaagtaaaaatgtacatacaaaaagtgggattctgctaaagtgtgtccttgagggaaatatatagcatattttaaatgtttatattagaaaatgaaatctaaaatcaataaccaaaagtttcaccctaggaaaccaaagaacgaagagcaagttgaattagagaaattgtagaggatgcccccctcccttcccacactcccacctctttccccttactccctacccctaccatttgagacacacagacacacacatcattttgcaacatgttcactttattttcatcaccatggggcacactctttggggtgtaaaatgtactctacaccctgttggctatttatctggggttagacctctggagacttttcagatagacttgaagtctctggccttgcccgggaattactggctgtccgaagagagactggagaaggtggtggtctccttgcccttgtggtcccgctatggctcattttgattgagttcctcgttcggctggtcagagtggctggatagtgttggcccactccattcctcaggtttttttgaagcggcggtcttttagggagagccttttgttcctggaacttccttgatgggtcccttttcccttccgggttgtcttgggaacctggaaggaaacagggagatcaaagaagggcactggtttggggaagaggatggaggaggggtgagaacaggggcttcatagagaaatggtgcaggctggggtgggggttgtgccaggggaggacagggtaggagtcagagcttgggtgggccgttcactttgatagggcttctgggccagggttgagaggatgccttccacttcctcgcctctttggtgttggtgggtggttgttggacaatgggctggaggctcgtggtttcctggacatcttcaccagaccagcgtctctcaacagtctactccagtccacctggtctctccaagcctcccccaggacagtgaaggcaggccagcaggctagaaactcacagcgcatttttatgttagtcttgtggtagaattccttttccaggaaaccttggtcttttctcttaacaccttcaactaattggatgaggcccatccacattatggaagttaaactgctttacttaaaatcaactgattgtaaatgttgatcacatctacaaaataccttcacagcaacatctagactactgtttgaccacacagctgagcagtatagcctagacaagttgacacatagtactagccattgcacatatcttgcaccatacagaaatgtaactcaaaatgaactacagactttaaatgtcaaaattactttttttttttctaggaggaaacaaaaaaaaaattgtgtcacctgaagttatgtcttaagtcagctcaggctgccataacaaaatgccattgagtgagtagctaaaacaacagaaatttattttttttctcacagttttgaagtctggaagtcctagatcaaggactggcggggttggcttctggtgatggccttattcgtggcttgtagatggccctttattaatctgtccattcttggcctttcctctgtgcatgtgcagagagagagagagagagagagagagagagagagagagagagagagaaagagagagagagagagagagagagagaaaggtcatgtaggcacaaaagtactttcttctgtctcttctcccttcttataaccaaactaattctatgggatcaaggtcccacccttatggcctcttttaacattaatcacttccctagaagcctcatctccaaatacagacaccctggggctgagggcttcaaaatatgaatttggtggaggacataagcattagcaaagaatagacacacagattaataaaacagaatagagctcagaaatagacctgcacgcatatagtcaggtgattcacaacaaaggcaataatggtgaaagtacaggttttccaacaaaaggtgtcggaacaattagacacctatacacaaattataataacctggacatatccttacatattccatgaaaactaactcaagatacatcataggtctaatgaaaaatgcaaaaacaatacaacctctataagaaaacataagagaaaatccacataactttgagtttggtgatgagtttttaaattcaacaccaaaagcatgatcaaggaaagaaaaatttgccaagttgattttattaaaataaaaatcttatgctcttcaaaggacaatgttaagagaatgaaaacagaagccacagactagcagaaaacatctgcggtacacatatgtgataaagaacttgtctctacaatatatgcgaattcttaaagctcaatgatagaaaaaatgaaaatagtcaaagatctgaacacacactacacaaaagaagatatacacatggcaaataagcataataaaagtactgagcaccctttggcattagataattgtgtactaaaatgggataccactgcacacctatcagaatgtccaaaatccatagaaaaccaaaacaaagaatacaagaccaagaacaattgccagcgaagatgtggagcaacggaaactctccttcattgctggtagaaatgcaaaatggcacagccactttggaaggcagtttggcgttttcttaaaaaaatgaaaatagacttagcacaagattcagcagccatactcaatcaatttacccaattgatttgaaaacttatgtctacataaaaatttgtatatgaatgtatacaatagcttatttcataatcaccaaaaatagaagcatccaaaatgtatttcatttggtgaatggatatatatatatatatatatatatatatatatatatatataaccagacattgatactactcctcaatgaaaaggaataagttccaagccacacaaagttatacatgactcttcagttcattatgctaagtgaaagaaaccagtctaaaaaggctacatagtataagattctatttatatgacattctggaaaatgcaaaattataaagatgaaaaacctatcagtggtggccatggggtttatccgacaagcacaagggaatttatcagggcagtgaaactggtatgcataatactgcaatggtggttccgtgcttgctttggtctgaatatttgtgttgccacaaaattcatctgctgaattaccaaggtgatggtattaggcagaaggtggggtatttggagaatgactagatcatgagagcagagtcctcatgaatgggattagtgtttttataaaacagactccacggagatcccttatcccttcttgcatgtgaggatctagggaaaaggcagctgtctatgaactagggagcaggactccaccagacatgaaatctgccagcaccttgatcttggacttcccaacctccagaatgtgagaaataaagttgcgttgtctataagccacccagtctatcactatttttgttatggaagcccaaacggactaagacaatggcacgaggcatttgtcaaaacccatagatctttacagcacaaagagtgaagcttaatgtatgtaaagtttaaaagtaacttaagaggttggagaatcacgggacggcaggtagaatgttccacacacacacacacacacacacacacctagttgtataatagatatatgaaaccaccacaatgaagcaagtggggggaaaagttaacacattttgtactccatcaaagaaatatatattttataaagtttaagttggccagataagtgtgtaacatagttgaacatttgataatcatttatttaattttttagatatgaaaactatcggctttttgttttaaaaaaatccttatcttttaaaaatgcatattaagttatttagagatgaaatggtctaatgccttagatttactccacgttattccagcagctcatatgcaggtaggcgagtgtttaactggaaccagatttgctgtgtatttaaagatgttcatgctcggtatcaagtatcctgggttcattatattcgttcctgttattctgtatgtgtgaaggctttccctaataaaacttttttatcataaatatgccattaaaagtgaaatcctaaatgaaactgaccactttgtagaaataaaataaatcagtaaccaaactgatccaaagaggaaaagaaaactttaactatacaacagaaactgtacaatattcaaagctcaagccaccctcaaacattccaggttagacagctttggaggccaattttaccaaatgatcagggaaaactaaccaccgccttatatcaactcttccagaacatacaaaagactgacaattgttcagttcattctcccaggctagccctcctggatttaaaaaccagatgaggaccacatacctcccctgatggaaaaagaacacatcaagtaagctctcttacacagcagtaaatatcctacataaattagtagtacattaaacgaataaacaggctctgcccaaggaaataaaatatgatttaacattagaaaaaacatctgtttcattgtgattccttacatacaaaatggaagagaaaaaaatttgatcctgccaacgggtacagaaaaagctttttaaataaatttaatatgaattcatggtaaaaaagaaaatatttaggcaacctatactgaaagagaacttccatttcctaaaatcaacagcaaacatacttaaatgtcaaatgttcgaagaattatcattcaagtcaggaacgagaagtagatgtagcctattatctctacatttgaaatcaggattgagacacaaagagctgtaagtaccgaaatgagtgagtggtatgaacattggaaaaacatgtagtgtttagtgataataccattatcgatcttgaaaattcaaaggaaaaggtatgcggaatattcaagtgcatcggccttcagaacgaggtgtgcaacagattactacagcaaaatcaaaatcttcacctcacgaaagcaataactaactacaacaattgatagacaatatgccacttgcaatagcaacaaaatccaagaattacctgaatagaagcctaataaaaatgtataagttgtttatagaggcaactaccgaagtatactgacatattcaggaaaaaagagcttgaaatccatagaggagtataacatattcattcacggggaacacaacagtgtaaaaatgtaaactcagcttaaattatttacaatttagtgccttacctgtagccgccgacattacaagcaaatttgggctgctgtgctctgcttcccaaatcaaccctgtaaatttatagaatggaaacagaaagtaaaacaccagtatcagcaagaaaatctacacaacaaaacagggaaagcccagagtgagactggagactgtgttgagctggtacttgtgtgtgacacttgcagtgtctgttggagggggttagcggcagagatgttggggaggtttgtagcctgcctagacggcagatgaaagaatgggtagaataaaagttttgaattttccacttcacttcattgcacaatctgaggcagcccctgaaaacacgatgccaagagccctaggtaatagcagtgtccaccaggaaaattgggtttgttaaggcagcatggctccagagttctgctaataacaacctgaaaccaacagagtgggagaggaattatgttttttaaaaaaattctttcaacagaacacaaagactggaatggaagtagactaggatatcagagtgaatcatgcatactaagggtaggtgttagttcatagaaataaatatatatattgctacctacatatatacttagaagatatgtaaaccgtatttcttcaattcagagaataaatcatttaggaccaaaggtttgccaagtgtagctctggctggggaggagcccccgtgggaaggtgtgcgtcttctcccagaggtcactatcatcgcgggagctcctgccctgcagggagcacctggcctggcacccgcagccattctctacaaggggtgcagatgcgcagatgcgcagatgctcagaggtgacagaaacagagcatctcccacccattccttcatcaaacagccaggagtgaggaagaggaccctcctgagtgaggactgaggatccaccctcacccacatagtgggaccacagaatccagctcagcccctcttgtcagccctggtacacactggcaatgatctcaccccgagcacacccctccccccaatgccacttcgggccgactcagagtcagagacttggtctgaggggagcagacacaatcggcagaggatggcggtccaggctcagtctggcatccaagtcaggaccttgagggatgaccaaaggcccctcccacccccaactcccccgaccccaccaggatctacagcctcaggatccccgtcccaatccctacccctacaccaacaccatcttcatgcttacccccacccccccatccagatccccatccgggcagaatccggttccacccttgccgtgaacccagggaagtcacgggcccggatgtgacgccactgacttgcgcattggaggtcagaggacagcgagattctcgccctgagcaacggcctgacgtcggcggagggaagcaggcgcaggctccgtgaggaggcaaggtaagacgccgagggaggactgaggcgggcctcaccccagacagagggcccccaataatccagcgctgcctctgctgccgggcctggaccaccctgcaggggaagacttctcaggctcagtcgccaccacctcaccccgccaccccccgccgctttaaccgcagggaactctggcgtaagagctttgtgtgaccagggcagggctggttagaagtgctcagggcccagactcagccaggaatcaaggtcaggaccccaagaggggactgagggcaacccaccccctaccctcactaccaatcccatcccccaacaccaaccccacccccatccctcaaacaccaaccccacccccaaaccccattcccatctcctcccccaccaccatcctggcagaatccgggctttgcccctgcaatcaacccacggaagctccgggaatggcggccaagcacgcggatcctgacgttcacatgtacggctaagggagggaaggggttgggtctcgtgagtatggcctttgggatgcagaggaagggcccaggccctcctggaagacagtggagtccttaggggacccagcatgccaggacagggggcccactgtacccctgtctcaaactgagccaccttttcattcagccgcgggaatcctagggatgcagacccacttcagcagggggttggggcccagccctgcgaggagtcaaggggaggaagaagagggaggactgaggggaccttggagtccagatcagtggcaaccttgggctgggggatcctgggcacagtggccgaatgtgccccgtgctcattgcaccttcagggtgacagagagttgagggctgtggtctgagggctgggacttcaggtcagcagagggaggaatcccaggatctgccggacccaaggtgtgcccccttcatgaggactggggatacccccggcccagaaagaagggatgccacagagtctggccgtcccttgttcttagctctgggggaacctgatcagggatggccctaagtgacaatctcatttgtaccacaggcaggaggttggggaaccctcagggagataaggtgttggtgtaaagaggagctgtctgctcatttcagggggttgggggttgagaaagggcagtccctggcaggagtaaagatgagtaacccacaggaggccatcataacgttcaccctagaaccaaaggggtcagccctggacaacgcacgtgggggtaacaggatgtggcccctcctcacttctgtttccagatctcagggagttgatgaccttgttttcagaaggtgactcaggtcaacacaggggcccccatctggtcgacagatgcagtggttctaggatctgccaagcatccaggtggagagcctgaggtaggattgagggtacccctgggccagaatgcagacagggggccccatagaaatctgccctgcccctgcggttacttcagagaccctgggcagggctgtcagctgaagtccctccattatcctgggatctttgatgtcagggaaggggaggccttggtctgaaggggctggagtcaggtcagtagagggagggtctcaggccctgccaggagtggacgtgaggaccaagcggactcgtcacccaggacacctggactccaatgaatttggacatctctcgttgtccttcgcgggaggacctggtcacgtatggccagatgtgggtcccctcatctccttctgtaccatatcagggatgtgagttcttgacatgagagattctcaagccagcaaaagggtgggattaggccctacaaggagaaaggtgagggccctgagtgagcacagaggggaccctccacccaagtagagtggggacctcacggagtctggccaaccctgctgagacttctgggaatccgtggctgtgcttgcagtctgcacactgaaggcccgtgcattcctctcccaggaatcaggagctccaggaaccaggcagtgaggccttggtctgagtcagtgtcctcaggtcacagagcagaggggacgcagacagtgccaacactgaaggtttgcctggaatgcacaccaagggccccacccgcccagaacaaatgggactccagagggcctggcctcaccctccctattctcagtcctgcagcctgagcatgtgctggccggctgtaccctgaggtgccctcccacttcctccttcaggttctgagggggacaggctgacaagtaggacccgaggcactggaggagcattgaaggagaagatctgtaagtaagcctttgtcagagcctccaaggttcagttcagttctcacctaaggcctcacacacgctccttctctccccaggcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttcactggctcatttctttaccattcactcagcatctgctctgtggaaggccctggtagtagtggggattctaaggtaagccagactcacgtctacccatagggtcatagagtctaggagctgcagtcatgtaattaaggtggcgagaagtcctctaggatgtagtggaaatgtaagacaggggtgagggtgtggggttccaggtgagagtggtgagtataaatgccctgagctggggcaatttgggatctgggaacctgcagttccttctgaaggagctgattctaatgatgcccggtgggtccagggccagattctcagagggtgagagaaaagcctggaatggaatgctaccctgagcagtttctttaggatggggatgaagagagaggaatctccacctggggctggaatggaaggtgtcctgtgtttttgcccaatgctgttgaacacagcccaagatctaggtgatggacacccatcatctgcaagggtttcctgagcgataaggctgaatttcccaggaagggtgacccagaagccactggccaggtgcttttctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcaccgttttagcagggatggtctcgatctcctgacctcgtgatccgcccgcctcggcctcccaaagtgctgggattacaggcgtgagccaccgcgcccggccggccaggtgcttttctgccaggcagggagagccagagctgactccattaaaaaggcattctaactaggttatctcaagtgcaatttgaccaattgtaagcacgggctagattctggatggtaacaaagtggatgaatatagtggtttggatgggaaagcagctgggagagagggaaggagttggtctttgactcacattctaggagctttgagctgcacctggctgggcaaaactcccgcacaaccaaattttgaagtgcattctctaagaggaaatacttaactgaattttatggaagaagcttctgtttggggctaattattccatgtcctattgagctgtatgttctctgataagtcctggagaacaacgacaacaacaacaaaatcccagtgttcgggcctcgggttaaagcatattggaaataacagccatccgccatttgtgaaacttccaatttacaccaggcccggagccaggtggttcacctgcgttgcatacactccgactgtcctactagacaggccttatcacatctgcttacagatgaagaatccagggcttacagagcttgtgaattgggatataagaacagggtatttcctgggtatttctcagtatcacgtggctagtaaggaacagggctggaaccagacccctggcatgaattcctttagagcccatgctgtccccacttctccgagcccgaggctgacctcctgacagcgacttcatttttcttctcagcactgcaccatgtctctcaggtgacaaaaagaaggaccttgaggccagcataatgaagcaggcctggagaacgcgacagtgagaatcaaacaccatttggggctggtgtgcgctaggttccttgagagctaactctgcccagttgtgggcatttctctgcagccccagcactttcagaattacagcacatttccccgggtcacttccatgtgtcctgtctgactctggaacctatagggcctgctgatcagctcctcactgatcctcacagaacagcccagaatcccctgctcacctcctgacagggagcattccttctcatagtagaagtcctctggctgttccgtctctcacccaggaagccatatgatgtcaaaaacccttttgtataaaaactcacacggggacagtgacgcttagacacttggttaccactctggttgtcttcaacacactctctaatcgttttctgaatgggctgaggagtctgattcgccatattatctaagggttcttgtgtgatgtcaccctgaagttagagggatttggaaccaccttgatacttgaaatcggactttcacagggcgtccttttggaattcgcctctgaatacatgcacagataaatgatcaaagagcaaaccgtctctcatgagtattagatgagaaaaaccttgggaaaccccagtggaacaaacatctacttactgaggctgaattcctaaatttctggagtcctccaggagtttaaaaactataccttgaaaacacgtcaactctaatgaaagaggaataattaagcagccttctgtttcttgtctgtttacctgctccacaggaaaatactggccttcagcgtgcctacctcgacaggtgtacaggcgtgtggagggtagcagaaattcacaggttaacattttgaccgggaatcaaatggaggaacaattctcagcctactaaggatttaaaggatattacaaaggaaagccttcctgctgagactttcaagattcttgaacagttagttgtgatcgtatgtttgaaaacatcagtcacatatttgacactggaaaacgctggagaacttcaaggtaaatttggccttctcagaaactcctcctagaaatgagaagggtagtataataccaaatgatcatagttgctttttgttgagcacccactatgtaacagtttatggggaagggtatagtactcacccacattttgtctctgtctccttcctggacacatgggaacagtaaagtccttgcagttaggatcatgtgacttttcctttacaccaatacaggagcagaagcattgtttgtcacatccaggcatttgagagccagtgtgccatttccatgctttctctccgctttcaacagcaaacatggcagcttcatcttgagatgacggaatcaaaaggtggaagcagcttggatccctgggtcatgtgagagtggagagcccctgccaaaccgcatcagaacttatttgcacataaaataaacttctgttgtgtcaagccattcatggttgttctgttgcatcagctagcaattacttaaactgacacggctagtatttctgttgtcagtattaaatattttttatttaaaatgtagtttggtatatattcttatttcaaaaatgatagaaatgtagataattcacaattttttttttacaaagctcctccacagttaacaacaccccccgcccccccgcagaggtcaccacaattaacaatgttgtgtattattttactgctgactctaggcttttcactgacaaactataacaatatattatttttattcaatatacaagaacaatgacatacatactgatctgcttttatcactttataaaatgcatgtaggatctttcgacaacagtatagatgatagatagatagatagatagatagatagatagatagatagatagagacaggtagatctttctcacttttgaaaccactttctataattctaaagtagacatgcaccaaaattaattaaactctttcttcctaatggacatataagttgtttcccatttgctatatgataaatagaataaaataaacatctctgcctatgaattttaggcaaacatggttttcttataagaaggctatattaacatggacattgggttaaagtgaaagggtgaaaatagtttaacatttaaaatatttctaaaatgttattacaaaagtgctgtaccaattcaaattctcataaaaatcacaattgatttaaaattctgaagtgtggacaggatatttcttctctgctttgagaaggatttggtgagactgaagaggaaccagggaaggagagcagacaggagaccctcagcctgtgagggaggatccagggaggatccaggagagagccattgctagtgtcaatgacagagagcacatgcaaaaccaagtccactgagacccaggcaggctggcactccgagctctaaatccagacttcaggccggtggggtcaggagcctgagggagagaagggggaagggagggggcaggacaggacaatgaacaggaataggcttgggaaatcctggcaccatcatcaccagctggaggaggccctgtgatctgagtgggtaagcctgttggctgaatgcaccagggctgtgctggtcaaccttcccgccctcagaatccccttccctctctccggaatagtttggctggctccctgcatcattctgggccagctacctctcttgaaccctccagtggtcctttgcaccttcgccagcatcccagatctgggagaggccttcatgcatgctgggggctggtgttttatcccctgggggccctccatagaggctgggctatgtgagtgtgttgctgactgatgaccaactgccaaaacaggccaggaatgcccatgagcagttgaaaggggcagtggggctgcatggaggagaaatgggaggaagagtgccctgggactagtcagctcagactctgcagatgaaggattggctgtggacgtgccttgaaaatgaaccaggtggtgactgcgtctcagatggacttctgtggcttctgaactcttggcacacaagaggactggtgtcgtagggcagtgatcgctggactatgttgccagcagacactgtctggcgtacagggctggcccaaggtgtgtacatgagcaggttgtatggcaaggcgttggagttggcagccttccttgttaaactgatggggatgtgtggggtccaataaaggaaacatcatgcaccatcctgttgggagcatcctcacctccatgacggtgtttgggcctggggataaggcatctgtagtgaccctctcgttggtagtttccacgggtttttctgagctcaagtgagcacaggtgaaggaactgtgggtttcttcatgcaggtcggaggcccaggccagaccgactccataatttgaaccaaagaattcccatgcctggtactttcattcatttcatgcacttattgattcctacagaaaacttttattcaatatatgctgaggaaacaccaagtcaaaaaaacacaagaaagcagcagtgcccttaactcagtctatggggggcgtgagggagatggtgaggtggaaagacacggaagagttttaggaagtgagggactgtgaactgatggagagaatctctattgacctgacttctgaggttggtgacgttgctcccttagttgagagggagggagaagggtaagagttggtggtgatttgatgaagaagagtgtggaggatgagatccgtgggcagcattttaaagctcagtctaggatttttttagacatggatgttttatgaaaatatatagtgttttaacacccacaggtagtgatgcacgtattgatatgtcacatgcctttgccacgtaataagatgaacgcaaggtcttcccacaactatacctacaatcgacatcacttttgtaagtattccctagaattctaaagtaggtgtgtgccatagttaattaaacctttcctttcctgataaacacatacgttcattcccatttgttgctatgattaatagaactgaaataaacatacgtttttggacagatatgcatgctttccaataagaaagatatagtaacatggacattgggttaaagtggaaatggtgtgaatagtttaactttttagaagtattgtcaaaattttattccaaaaatactgtaccaattaattttctcacaaattaatagatgtgaatatcctacactcacagaaagattttgtgttatcaatcttctcatttttggtgaaaattatgaataaaatttagtgaagaaatattgtttcactgttattttgtgtctttgctttctctaattaggttaagtacacactaacttaatccctcacccatatgaagttggatttatacagtgacatcctgagtaacatttctctaggcatggtttaacattctgaaatggggacaggacatttctcttgtgctttgagaaggaattggtcagaatgaacaggagccagggaaggagagcagacaggacaccctcagcccatgagggtaatcgggaggatccagcactgatatggtttgattgtttccccacccaaatctcatcttgaattgtagctcccataacctccacgtgtcatgggagggatcaggtgggaggtaattgaatcacagggataagtttttcccatgctgttctcgccgtagtaaataagtcttaggagatctgatgttttcacaaagggcagttcccctgcacatgctctcttgcctgctgccatgtgagacatatctttgctcctccttccccttctgccatgattgtgaggccttcccagccatgtagaactgtcagtccattaaacctcttttttttattattataaattacccagtctcaggtatttcttcatagcagtatgaaaatgaacaaatacaaggggagagcaatggccagagtccatgagagagaccgtatatgaaaccaagtccacatttccccaggcaggctggcattcagaggtctgaatccagagttcagctcggtggaggcagggacctgagggagagaagggcgaagagaggggtgagggcaggacaatgaaaaggaataggcttgggaaattccagcaccatcatcactagctggagggggccgtgtgatctgaatgggcaggcctgttgatggaatgcaccagcgatgtgctggagacgcaaccctccctcagaatccccttccctctctcacgaagagtatggctggctccctgcatcattccgggcaagctccctctcttgaccactccagtggtcgtgtgtaccatttccagcgtcccggggcagggagttgtctcatgcctgctgggggctgctgttttatcccctgtgaactctccatggagcctggactatgtgaatgggttgctgacttttgagcaacagccaagacaggccagaaatatttatgagcagtggaaggtgagggtggcagcaaggctgcatggaggggaatttggaggaagagtaccctaggactagtcagctgcgactctgcagatgaaggattggctgtggatgtgcaatgagaatgatccaggtggtgaccatgtctcagatggacttctgaggcttctgagctcttgagacaaaagcagacaggtatcctggggctctaatcactggcctatgatgccaccagacagtgtctggggtagagggctggtccaaggtgtgtatgtgagcaggttggatggcaaggcagtgcagatggcacccttccttgttaaactgatggggacgtgtggggtccaatacaggaggcatcatgcacaatactgttgggagcatcctcacctccatgatagtgtttgggcatggggagtaggcatctgcagtgatgctctcaatgatagtttccaggggatttctaaactcaagtgagcacaggtgatggaactgtgggtttcttcaggtaggcgggaggccaaggcaggggcagcctccacgttttgaatcaatgaactcccatgcctggtaatttcattcattcatgcacttattgattcctacagaaaacttttattgaatatatgctgaggaaacagcaagtcaacaaaacaaaagaaagtggcaaggcccttaatactgtctgtaaggggatgggggagatggagaggaggtgtgaatcgcccatctgagccagggagtccaggaaggcagagccagacttggggacaggcagtgtgcaacaaagggagtgacagcctgtgtccaggcaagcaagcgctctttctatgacactatcaatctggttttcctcctggatgttgcctgtgtgtgaaagcaactgctgttctctgtgcctgcctgcctctgttaatagggaaaatgctaatggttggcagatgctcacttctgctcaccttgggtcacctctactgaagggatggtttgacagcaaaaggacaggaagaaacttttggggagtatgaatatattttgcaccttctatgtggttgtgatttcatgggactacacatttgtcaaaactgtttaaattgtttctcagtatttaggagaaaaagtaagcagaaaaccaggaaggatatagatgacctgaaaagcaccattaactactctgaccaattaaaataatgagaaaagcactgcattcaacaacagcagaataaacattcctctcaagtgtgcatgaaatatttcccaggatagatggtattctgggccatcaaacaaagcttacaaattgaaaaaaaaaatagaaataataaaaagcctcttcttagaccataatataattaaattcaaaaccaaacaccaagatatctgaaaaatgcccaaatattggaaattttaaaatatgctcctaaataacctatgggtcaaagagggagtctcaggagaattttaaaaatacattaagttgaatgaaaataaaaatatacatacaaaaatgggattcagctaaagtgtttccttgagggaaatgtatagcatattttatgtttatattagaaaatgaaatctaaaatcaataaccaaaactttcaccctaggaatccaaagaacgaagagcaatttgaatttaaagaaattgtagaggatccccccatcccttcccacattcccacctcttccccttaagccctacccccaacctttgagacacacagacacacacatcattttacaacatgttcattttatttctatcaccatggggcataccctttggggtgtaaaacgtactctacaccctgttggctatttatctggggttagacttctggagacttttcagatagacttgaagtctctggccttgcctgggaattactggctgcccaaggaagcactggagaaggcggtggtctccttgcccttgtggtcctgctgtggcgcattttgattgagttcctggttcggctggtcagagtggctggatagtgttggcccactccattcctcaggtttttttgaagcggtggtcttttagggagagccttttgttcctggaacttccttgacgggtcccttttcccttttgggttgtcttgggaacctggaaagccaacagggagatcacaggagggcactggtttggggaagaggatggaggaggggtgagaacaggggtttcatagagaaatggtacaggctggggtgggggttgtgccaggggaggacagggtaggagtcagagcttgggtgggccattcactttgatagggcttctgggccagggatgagaggatgctttccccttcctcgcctctttggtgttgatgggtggttgttggaaaatgggctggaggctcgtggtttcctggacatcttcaccagaccagtgtctctgtacagtctactccagtccacctggtctccccgagcttcccccaggacagtgaaggcaggccagcaggctagaaactcacacgacattattatgttagtcttgtggtagaattccttttccaagaaaccttggtcttttaacaccttcaactaattggatgaggcctatccacattatggaagttaaattgctttacttaaagtcaactgattgtaaatgttgatcacatctacaaaataccttcacagcaacatctagactactgtttgaccacacagctgagcagtatagcctagacaagttgacacataatactagccactgcaaatatcttgcaccgtacaaaaatgtgactcaaaatgaaccgcagtcttaaatgccaaaattacgggctttttttctaggaggaaacaaaaaaaaattgtgttacctgaggttatgtactagtcagctcaggctagaataacaaaatgtcattgactgagtagctggaacaacagaaatttatcttttttcacagttttgaagtctggaagtcccagatcaaggactggcggggttggcttctggtgatggccttattcctggcttgtagatggccctttctcaatatgtccattcttggcccttcctctgtgcatgtgcagagagcgcgcgagagagacagcaagctcatgcaggcacaaaaatgctatcttctgtctcttctcccttcttataaccacactaattctatgggatcaaggccccacccttatgacctcttttaacattaatcacttccttagaagcctcatcaccaaatacagacaccctggggctgagggcttcaaaatatgaatttggtggaggacctaagcattagcaaagaatagacacacagattaataaaacagaatagagctcagaaatagacctgcacacatatagtcaggtgattcacaacaaaggcaataatggtgaaagtacaggttttccaacaaaaggtgtcggaacaattagacacctatacacaaattataataacctggacatatccttacatattccatgaaaactaactcaagatacatcataggtctaatgaaaaatgcaaaaacaatacaacctctataagaaaacatgagagaaatccacataactttgagtttggagatgagtttttaaattcaacaccaaaagcatgatcaaggaaagaaaaatttgccaagttgattttattaaaataaacatcatgtgctcttcaaaagacaatgttaagagaatgaaaacagaagccacagactagcagaaaacatctgcggtacacatatgtgataaagaacttgtctctacaatatatgcgaattcttaaagctcagcgatagaaaaaaatgaaaatagtcaaagatctgaacacacactacacaaaagaagatacacacatggcaaataagcataataaatgtactaagcgtgttttgtcattagataattgtgtactaaaatgagataccactacacacctattagtatgtccaaaatccataaaaaagcaaaacaaagcaaacaaaaccaagaccaattgccagggaagatgtggagcaacagaaactctcattcatagctcgtggaaatgcaacatggcacagccactttggaagacaatttggcgttttcttaaaaaacggaacatagacttagcgtaagattcagcagccatactcaatcaatttacccaattgatttgaaaacttatgtctacataaaaatttgtatatgaatgtatacaatagcttatttcacaatcaccaaaaatagcagcatccaaaatgtatttcatttggtgaatggattatatatatatatatatatatatatatatatatatatatatatatatatatatacatacacatacacacacacacgcattaaaatatggtacacccaatgatactactactcctcaatgaaaaggaataagttacaagctgcacaaagttttacatgactcttcagttcattatgctaaacgagtctaaagaaacgagtctagaaagaaacgagtctaaaaaggctacatagtatacgagtctatttatatgacattcaggaaaaggcaaaattataaagatgaaaaacctatcagtggcagccaagggggttatctgacaagcacaggggatttatcagggcagtgaaactagtatggtaatactgtaatggtggttccgtgcttgctttcatctgaatatttgtgttcccacaaacttcatctgctgaaataccaaggtgatggtattaggtagaaggtggggtatttggagaatgactagatcatgagagcagagtcctcatgaatgggatcagtgtttttataaaatagtccccacagagatcccttgccccttcttccatgcaaggacatagggaaaaggcaggtgtctatgaactagggagcaggactccaccagacatgaaatctgccagcaccttgatcttggactttccaacctccagaatgtgagaaataaagttgtgttgtttataagccacccagtctacactatttttgttatggaagcccaaacggactaagacaatggcaagaggcatttgtcaaaacccatagatctttacagcacaaagagtgaagcttaaggtatgtaacgtctaaaagtaacttaagaggttggagaatcacagaacagaatgtaaaatgttacacacacagaaacctagctgtattatagatgtatgaaaccaccacagtgaagcaagtggggggaaagttatcatatttgggtacttcatcaaagaaatatatattttataaagtatatgtcttccagataagtttgtaaaatagttgaacatttgataatcatttatttaattttttagatatcaatgctattgggtttttgtttaataaaaagtccttttcctttaaaatgcatgttaaattgtttagagatgaaatggtctaatgccttagattggctccacgttattacagaagctcatatgcaggtaggcgagtgtctaactggaaccagctttgctgtgtatttaaagttgttcatgctcggtatcaagtatcctgggttcataatattagtttctgttattctgtatgtgtgaaggctttccctaataaaacgttttttatcacaaatatgccattaaaagtgaaatcctaaatgaaactgaccacttcatagaaataaaatacatcagtaaccaaactgatccaaaaagaaaaagaaaactttaattaaactatacaaactgaaactgtacaatattcaaagctcaagccaccctcaaacattccaggttaggcagttttggaggccaattctaccaaatgatcagggaaaactaaccaccatcttatatcaactcttccaaaacatacaaaagattgacaattgttcagttcattctcccagactagccctcctggattcaaaatcagatgaggaccacatccctccccgatggaaaaagaacacaccaagtaagctcccttacctagcagtaaataccttacctaaattagtagcatattaaacaaatagacaggctctgcccaaggaaataacatatgatttaacatcagaaaaaaaaaaaacggtttcattgtaattccttacatacaaaatggaggagaaaaaatttgatcctgtcaaagggtacagaaaaagctttttaaagacatttaatgagtttatggaaaaaagaaaatatttatttaacctatattcaaagagcacttccatttcctaaaatcaacagcaaacatacttaaatgtcaaatgttcgaagaactatcattccagtcaggaacgagaagtagatgaagcctattatctctacgtttgaaatcaggattgagacacaaaaagctataagtatcaaaatgagtaagtggtatgaatattggaaaaacatgtaatgtttagtgataataccattatcgatcttgaaaattcaaaggaaaaggcatgtggaatattcaagtgcatcggccttcagaatgaggtgtgcaacagattactacagcaaaatcaaaatcttcacctcacgaaagcaataactaactacagcaattaatagacaatatgccatttgcaatagcaataaaatccaagaattacctgaatagaagtctaataaaaatgtataagctgcttatagaggcaactatcgaagtatactgacatattcaggaaaaaatagcttgacatacatagaggagtataacatattcattcatggggaacacaacagtgtaaaaatgtaaactcagcttaaattatttacaatttagtgccttacctgtagtcgccgacattacaagcaaatttgggctgctgtgctctgcttcccaaatcaaccctgtaaatttatagaatggaaacagaaagtaaaaaaccagtattagcaagaaaatctacacaacaaaacagggccagtccagggtgagactgaagaccttgttgagctggtacttgtgtgtgacacttgccgtgtcggttagagggggttagcggcagggatgttggggaggtttgtagcctgcctagacggcagataacagaatgggtagaataaaagttttaaaatttccacttcacttcattgcacaatctgaggcagctcctgaaaacacgatgccaagagccctaggtaatagcaggacaccaggaaaattgggtttgttaaggcagcatggctccagagttctgctaataacaacctgaaaccaacatagtgggagaggaattacgtttaaaaaaaaattccttcaacagaacacaaagactggaatagaagtagattaggatagtaagagtgaacgatgcatactaagggtaggtgttagttcgtagaaataaatatatatatcgctacctacatatatacttggaagatatgtaaaccgtatttcttcaattcagtgaataaatcatttaggaccaaaggtttgccaagtgtagctctggctggagaggagctcccgtgggaaagtgtctgtcttcttccagaggtcaatacgatcgtgggagctcccgccctgcagggagctcctggcctgggacccgcagccattctctacaaggggtgcagctgtgcaaatgcacagacgttacagaaacagagtatctcctgccaatcacttcatccaacagccaggagtgaggaagaggaccctcttgagtgaggactgagggtccaccctcccccacgtagtgggaccacagaatccagctcagtccctcttgtcagccctgataaacttaggcaataatgtcaccccgaccgcacccctcccccagtgccacttcagggggactcagagtcagagacttggtctgaggggagcagacacaatcggcagaggatggcggtccaggctcagcctggcatccaagtcaggaccttgagggatgaccaaaggcccctcccacccccaactcccccaaccccaccaggatctacagcctcaggatccccgtccctatccctacccctacccccaacaccatcttcatgcttacctccacctccatctggatccccatccaggaagaatccagttccacccctgctgtgaacccagggaagtcacggggccggatgtgacgccactgacttgcgcgttggaggtcagagaacagcgagattctcgccctgagcaacggcctgacgtcggtggagggaagcaggcgcaggctccgtgaggaggcaaggtaagatgccgagggaggactgaggcgggcctcaccccagacagagggcccccaataatccagcgctgcctctgctgccaggcctggaccaccctgcaggggaagacttctcaggctcagtcgccaccacctcaccccgccaccccccgccgctttaaccgcagggaactctggtgtaagagctttgtgtgaccagggcagggctggttagaagtgctcagggcccagactcagccaggaatcaaggtcaggaccccaagaggggactgagggtaacccccccgcacccccaccaccattcccatcccccaacaccaaccccacccccatcccccaacaccaaacccaccaccatcgctcaaacatcaacgggacccccaaaccccgattcccatccccacccatcctggcagaatcggagctttgcccctgcaatcaacccacggaagctccgggaatggcggccaagcacgcggatcctgacgttcacatctgtggctcagggagggaagggggtcggtatcgtgagtacggcctttgggaagcagaggatgggcccaagcccctcctggaagataatggagtccggagggctcccagcatgccaggacaggggcccaaagtacccctgtctcaaactgagccaccttttcattcggccgcgggaatcctagggatacagacccacttcagcagggagttggagcccagccctgcgaggagtcaaggggaggaagaagagggaggactgaggggaccttggagtccagatcagtggcaaccttgggctgggggatcctgggcacagtggcctaatgtgccccatgctcattgcgacttcagggtgacagatttgcgggctgtggtctgaggagtggcacttcaggtcagcagagggaggaatcccaggatctgccggacccaaggtgtgcccccttcatgaggactggggatacccccggcccagaaagaagggatgccacagagtctggctgtcccttattcttagctctaagggaacccgatcagagatagctccaattggcaatgtcatttgtaccacaggcaagaggttggggaaccctcagggagataaggtgttggtgtaaagaggagctgtctgctcatttcagggggttgggggttgaggaagggcagtccctggcaggagtaaagatgagtaacccacaggaggccatcagaagcctcaccctagaaccaaaggggtcagccctggacaacctacctgggagtgacaggatgtggctcctcctcacttctgtttccagatctcagggagttgaggaccttttcttcagagggtgactcaggtcaacacaggggcccccatgtagtcgacagacacagtggtcctaagatctaccaagcatccaggtgagaagcctgaggtaggattgagggtacccctgggccagaacgctgacagagggccccacagaaatctgccctgcccctgctattccctcagagagcctgggcaaggctacctgctgaggtccctccattatcctgggatctttgatgtcagggaaagggaggccttggtctgaaggggctgcactcaggtcagtagagggaggctctcaggccctagcaggagtagtggtgaggaccaagcaggctcgtcacccaggacacctggactccaatgaatttggacatctctcattgtcctttgtgggaggatctggttatgtatggccagatgttggtcccctcatgtccttctgtaccgtatcagggatgtgaattcttgccatgagagtttctttggccagcaaaagggcggtattaggccctgcaaggagaaaggtgagggccctgagtgagcacagaagggaccctccaccccagtagagtggggacctcacagagtctggccgaccctcctgacaattttgggaatctgtggctgtacttgcagtctgcaccctgaggcccatggattcctctcccaggaatcaggagttccaagaacaaggcagtgaggccttggtctgaggcagtgtcctgaggtcacagagcagagggggtgcagacagtgccaacactgaaggtttgccttgaatgcacaccaagggccgcaccggccccagaacacatgggactccagagcgcctggcctcaccctccctactgtcattccttcagcctcagcatgtgctggccggctgtaccctgaggcgccctctcacttgttccttcaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgatatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaataattcttcctgttcactggctcatttattttccattcactcagcatctgctctgtggaaggctctgcgttagtagtgcggatgctaaggtaagcaagactcacgcctacccgtagggttgtagagcctaggacctgcagtcatataattaaggtggcaagaagtcctgtaagatgtagaggaaatataagagaagggtgagggtgtggggttccaggagggagttgtggagtgtaaatgccctgagctggggcattttggactttgggaacctgcagttccttctgaaggagctgactctgatgaagctgggtgggtccagggcccacagattctcagtgaatgagagaaaagcctggaatggaaagcaactctgagtagtttatttcggatgggggatgaacagagaggaatctccacctggggctggaatagaaggtgtcctgtgcttttgtcccactgctattgaacacaacccaagatctaggtgatgaaaatctatcatctgcaagggtttcctgagcgataaggctgaatttcccaggaagggtgacccagaagccactggccaggtgcttttctgccaggcagggagagccagagctgactccattaaaaaggcattctaactaggttatctcaagtgcaatttgaccaattgtaggcgtgggccagattttggatggtaacaaaatggatgaaaatagtggtttgggtgggaaagcagctgggagagatggaaggaattggtctttgacacacattctaggagttttgggttgcacctggctgggcaaaactcccgcacacacaaagtttgaagtgcattctctaagaggaaatacttaactgaattttacaggtgaagcttcctttttggcctaattatcccatgtcctgttgagctgtatattttctgatgactcctggagaacaacgacaacaacaacaaagtcccagagtgttaatgcctaggctttaaaaatattagaaataacagccatcggccatttgttaaacttctaatttccaccacgcccggagtttctgttgctccacatcttcactggcaattggtcttggttttgttttgcttttttatgggttttagacattctaataggtgtgtagtagtatctcactttagtacacaattatctaatgccaaaggacactcagtattttattatgcttatttgccctgtgtgtatcttcttttgtgtagattgtgttcagatctttgactattttcatttttttctatcattgagctttaagaattcgtatatattgtagagacaagttctttatcacatatgtgtaccacagattttttctgctagactgtggcttgttttcattctcttaacattgtcctttgaagagcataaaatttttattttaataaaatcaacttggcaaatttttctttccttgatcatgcttttggtgttgaatttaaaaactcatcaccaaactcaaagttatgtggattttctcttatgttttcttttagaggttgtatagttcttgtatttttcatcaggtctatgatgtattgagttaattttcgtgcaatatgtaaggatatgtctaggttattataatttgtgtataggtgtctaattgttcaggcaccttttgttggaaaacctgtactttcaccattattgcctttgttgtgaatcacctgactatgtgtgtgcaggtctatttctgagctctattctgttttattaatctatgtgtctattctttgctaatgcttatgtcctccaccaaattcatattttgaaaccctcagccccagggtgtcagtatttggagatgaggcttctaaggtagtaattaatgttaaaagaggccataagggtgggagcttgatcccacagaattagtgtgattgtaagaagggagaagaaacagaagaaagtacttttgtgcctgcatgacttctctctctctctctctttctttctctctctctcttcctctctctctctctgcacatacacagaggaaaggccaagaactgacaaattaataaagggccatctacaagccaggaataaggccatcaccagaagacaaccccgccagtccttgatctgggacttccacatttcaaaactgaaaaaagataaatttctgttgtttcagctactcagtcaatggcattttgttatggcagcctaagctaagacataacctcaggtaacacaattttttttgttttgtcctagaaaaaaaaagcaatgtaattgtgacatataaagtctgtggctcattttgagttacatttttgtatggtgcaagatatgtgcaacggctagtattatgtgtcaacttgtctaggctatactgctcagctgtgtggtcaaacagtagtctagatgttgctgtgaaggtattttgtagatgtgatcaacatttacaatcagttgactttaagtaaagcagtttaacttccataatgtggataggcctcatccaattagttgaaggtgttaagagaaaagaccaaggtttcctggaaaaggaattctaccacaagactaacataaaaatgcgctgtgagtttctagcctgctggcctgccttcactgtcctgggggaggcatggagagaccaggtggactggagtagactgttgagagacactggtctggtgaagatgtccaggaaaccacgagcctccagcccattgtccaacaaccacccaccaacaccaaagaggtgaggaagtggaaagcatcctctcaaccctagcccagaagccctatcaaagtgaacggcccaccgaagctctaaatcctaccctgtcctcccctggcacaacccccaccccaccctgccccatttctctatgaagcccctgttctcaccccttctccatcctcttccccaaaccagtgcccttctttgatctcctggttggttttccaggttgccaagacaacccggaagggaacagggacccgtcaaggaagttccaggaacaaaaggctctccctaaaagaccgccgcttcaaaaaaacctgaggaatggagtgggccaacactatccagccactccgaccagccaaaagaactcaatcaaaatgagacacagtaggaccacaagggcaaggagaccaccaccttctccagtctctctttgggcagccagtaattcccgggcaaggccagaaacctcaaggctacctgaaaagtctccagaggtctaaccccagaaaaatagccaacagggtgtagagtacattttataccccaaagggtataccccatggtgacgaaaataaaatgaacatgttgtaaaatgatgtgtgtgtctgtgtgtctcaaatggtaggggtagggagtaagggggaagaggtgggagtgtgagaagggagggaggtgggatcttctacaatttctttaaattcaacttgctcttcgttctttggtttcctagagtgaaagttatggttattgattttagatttcattttctaatataaacatttaaaatatgctatatatttccctcaaggacacactttagcagaatcccactttttgtatgtacatttttattttcattcaacttaatgtatttttaaaattctcctgggactccctctttgacccataggttatataggagcttattttaaaatttccaatatttgggcatttttcagatatcttggtgtttggttttgagttttattatattatggtctaagaagaggctttctattatttctattcttttcaatttgtaagctttgtttgatggcccagaataccatctatcttgggagatatttcatgcacacttgagaggattgtttattctgctattgttgaatgcggtgcttttcttattgttttatttagtcagagtagttaatggtgcttttcaggtcatctatatccttcctggttttctgcttactttttctcctaagtactgagaaacaaatcaaagagttttgacaaacatttagtcccatcaaaccacaaccacagtgaaggtgaaaaatatattcatcctccccaaaagtttcttcctgtctgcttgctgtcaaaccatctcttcagtagaagtgatccaaggtgagcagaagtgagcatccgctgaccatgaccattttccctgttaacaaaggcaggtaggcacagagagcagcagttgctttcagacacaggcagtatccaggaggaaaaccagaccaatactgtcatagaaggagagctttctggcctggacacaggctgtctctccttttcttgcacactgccagtccccaagtctggctctgccttcctggcctccctggctcagatgggcgattcacacctcctcaccatctccccccactccctacagactgaattaagggctttgccactttctattgttttgttgacttggtgtttcctcagcatatattgaataaaagttttctgtaggaatcaatacgtgcatggaatgaatgaaatcacctggcatgggaattctttgattcaaattatggagtctgcccttcctgggcctcctgcctacatgaagaaacccacagttctttcacttgtgctcacttgagttcagaaattccatggcaactaccacggagagggtcactgcagacaccttctccccaggctcaaacacttatcatggaggtaaggatgcttccaacaggatggtgcatgacgcttcctctattggaccaaacacatccccatcagtttaacagggaagggtgccaactccactgccttgccatccaacctgctcacatacacagcttgggccaaccctctaccccagaccctgtctggtggcaacacaggcctgtgatcagtgccccagtacacctgtctcctcatgtgccgagagctcagaagcctcacgagtccatctgagacatggtcaccacctggatcattttcattgcatgtccacagccaatccttcatctacagagtaggagcttactagtctcagggcactcttcctccaacttcccctccatgcagccttgctgccaccttttacacctcataaatattcctggcctgtcttggttgttgctcatcaatcagcaacccattcacatagtccaggctctatggagggtccacaggagataaaacaggagcccgcagcaggcttgaagacaacttcctgccctgggacgctggcaaaagtgcacacgaccactggagtggtggagagagggagctcacccagaatgatgcagggagccagccatactcttcgtgagagagggaaagggattctgagggagggttgggtgtctagcacaaccgtggtgtattcagtcaacaggcctgcccattcagatcacacggccccctccagctggtgacgatggtgctggaatttcctaagcctattccttttcattgtcctgccctccctcctctcttcccccttctctccctcaggtccctgcccccaccgggctgaactctggattcagacctctgaatgccagcctgcctggggaaatgtggacttggtttcatatacggtctctctcatggactctggccattgctctccccttgtatttgttcattttcatactgctatgaagaaatacctgagactgggtaatttataataataaaaaaaagaggtttaatggactgacagttctacatggctgggaaggcctcacaatcatggcagaaggggaaggaggagcaaagatatgtctcacatggcagcaggcaagagagcatgtgcaggggaactgccctttgtgaaaacatcagatctcctaagacttatttactacggcgagaacagcatgggaaaaacttatccctgtgattcaattacctcccacctgatccctcccatgacacgtggaggttatgggagctacaattcaagatgagatttgggtggggaaacaatcaaaccatatcagtgctggatcctcccgattaccctcatgggctgagggtgtcctgtctgctctccttccctggctcctgttcattctgaccaattccttctcaaagcacaagagaaatgtcctgtccccatttcagaatgttaaaccatgcctagagaaatgttactcaggatgtcactgtataaatccaacttcatatgggtgagggattaagttagtgtgtacttaacctaattagagaaagcaaagacacaaaataacagtgaaacaatatttcttcactaaattttattcataattttcaccaaaaatgagaagattgataacacaaaatctttctgtgagtgtaggatattcacatctattaatttgtgagaaaattaattggtacagtatttttggaataaaattttgacaatacttctaaaaagttaaactattcacaccatttccactttaacccaatgtccatgttactatatctttcttattggaaagcatgcatatctgtccaaaaacgtatgtttatttcagttctattaatcatagcaacaaatgggaatgaacgtatgtgtttatcaggaaaggaaaggtttaattaactatggcacacacctactttagaattctagggaatacttacaaaagtgatgtcgattgtaggtatagttgtgggaagaccttgcgttcatcttattacgtggcaaaggcatgtgacatatcaatacgtgcatcactacctgtgggtgttaaaacactatatattttcataaaacatccatgtctaaaaaaatcctagactgagctttaaaatgctgcccacggatctcatcctccacactcttcttcatcaaatcaccaccaactcttacccttctccctccctctcaactaagggagcaacgtcaccaacctcagaagtcaggtcaatagagattctctccatcagttcacagtccctcacttcctaaaactcttccgtgtctttccacctcaccatctccctcacgccccccatagactgagttaagggcactgctgctttcttgtgtttttttgacttggtgtttcctcagcatatattgaataaaagttttctgtaggaatcaataagtgcatgaaatgaatgaaagtaccaggcatgggaattctttggttcaaattatggagtcggtctggcctgggcctccgacctgcatgaagaaacccacagttccttcacctgtgctcacttgagctcagaaaaacccgtggaaactaccaacgagagggtcactacagatgccttatccccaggcccaaacaccgtcatggaggtgaggatgctcccaacaggatggtgcatgatgtttcctttattggaccccacacatccccatcagtttaacaaggaaggctgccaactccaacgccttgccatacaacctgctcatgtacacaccttgggccagccctgtacgccagacagtgtctgctggcaacatagtccagcgatcactgccctacgacaccagtcctcttgtgtgccaagagttcagaagccacagaagtccatctgagacgcagtcaccacctggttcattttcaaggcacgtccacagccaatccttcatctgcagagtctgagctgactagtcccagggcactcttcctcccatttctcctccatgcagccccactgcccctttcaactgctcatgggcattcctggcctgttttggcagttggtcatcagtcagcaacacactcacatagcccagcctctatggagggcccccaggggataaaacaccagcccccagcatgcatgaaggcctctcccagatctgggatgctggcgaaggtgcaaaggaccactggagggttcaagagaggtagctggcccagaatgatgcagggagccagccaaactattccggagagagggaaggggattctgagggcgggaaggttgaccagcacagccctggtgcattcagccaacaggcttacccactcagatcacagggcctcctccagctggtgatgatggtgccaggatttcccaagcctattcctgttcattgtcctgtcctgccccctcccttcccccttctctccctcaggctcctgaccccaccggcctgaagtctggatttagagctcggagtgccagcctgcctgggtctcagtggacttggttttgcatgtgctctctgtcattgacactagcaatggctctctcctggatcctccctggatcctccctcacaggctgagggtctcctgtctgctctccttccctggttcctcttcagtctcaccaaatccttctcaaagcagagaagaaatatcctgtccacacttcagaattttaaatcaattgtgatttttatgagaatttgaattggtacagcatttttgtaataacattttagaaatattttaaatgttaaactattttcaccctttcactttaacccaatgtccatgttaatatagccttcttataagaaaaccatgtttgcctaaaattcataggcagagatgtttattttattctatttatcatatagcaaatgggaaacaacttatatgtccattaggaagaaagagtttaattaattttggtgcatgtctactttagaattatagaaagtggtttcaaaagtgagaaagatctacctgtctctatctatctatctatctatctatctatctatctatctatctatctatcatctatctatactgttgtcgaaagatcctacatgcattttataaagtgataaaagcagatcagtatgtatgtcattgttcttgtatattgaataaaaataatatattgttatagtttgtcagtgaaaagcctagagtcagcagtaaaataatacacaacattgttaattgtggtgacctctgcgggggggcggggggtgttgttaactgtggaggagctttgtaaaaaaaaaattgtgaattatctacatttctatcatttttgaaataagaatatataccaaactacattttaaataaaaaatatttaatactgacaacagaaatactagccgtgtcagtttaagtaattgctagctgatgcaacagaacaaccatgaatggcttgacacaacagaagtttattttatgtgcaaataagttctgatgcggtttggcaggggctctccactctcacatgacccagggatccaagctgcttccaccttttgattccgtcatctcaagatgaagctgccatgtttgctgttgaaagcggagagaaagcatggaaatggcacactggctctcaaatgcctggatgtgacaaacaatgcttctgctcctgtattggtgtaaaggaaaagtcacatgatcctaactgcaaggactttactgttcccatgtgtccaggaaggagacagagacaaaatgtgggtgagtactatacccttccccataaactgttacatagtgggtgctcaacaaaaagcaactatgatcatttggtattatactacccttctcatttctaggaggagtttctgagaaggccaaatttaccttgaagttctccagcgttttccagtgtcaaatatgtgactgatgttttcaaacatacgatcacaactaactgttcaagaatcttgaaagtctcagcaggaaggctttcctttgtaatatcctttaaatccttagtaggctgagaattgttcctccatttgattcccggtcaaaatgttaacctgtgaatttctgctaccctccacacgcctgtacacctgtcgaggtaggcacgctgaaggccagtattttcctgtggagcaggtaaacagacaagaaacagaaggctgcttaattattcctctttcattagagttgacatgttttcaaggtatagtttttaaactcctggaggactccagaaatttaggaattcagcctcagtaagtagatgtttgttccactggggtttcccaaggtttttctcatctaatactcatgagagacggtttgctctttgatcatttatctgtgcatgtattcagaggcgaattccaaaaggacgccctgtgaaagtccgatttcaagtatcaaggtggttccaaatccctctaacttcagggtgacatcacacaagaacccttagataatatggcgaatcagactcctcagcccattcagaaaacgattagagagtgtgttgaagacaaccagagtggtaaccaagtgtctaagcgtcactgtccccgtgtgagtttttatacaaaagggtttttgacatcatatggcttcctgggtgagagacggaacagccagaggacttctactatgagaaggaatgctccctgtcaggaggtgagcaggggattctgggctgttctgtgaggatcagtgaggagctgatcagcaggccctataggttccagagtcagacaggacacatggaagtgacccggggaaatgtgctgtaattctgaaagtgctggggctgcagagaaatgcccacaactgggcagagttagctctcaaggaacctagcgcacaccagccccaaatggtgtttgattctcactgtcgcgttctccaggcctgcttcattatgctggcctcaaggtccttctttttgtcacctgagagacatggtgcagtgctgagaagaaaaatgaagtcgctgtcaggaggtcagcctcgggctcggagaagtggggacagcatgggctctaaaggaattcatgccaggggtctggttccagccctgttccttactagccacgtgatactgagaaatacccaggaaataccctgttcttatatcccaattcacaagctctgtaagccctggattcttcatctgtaagcagatgtgataaggcctgtctagtaggacagtcggagtgtatgcaacgcaggtgaaccacctggctccgggcctggtgtaaattggaagtttcacaaatggcggatggctgttatttccaatatgctttaacccgaggcccgaacactgggattttgttgttgttgtcgttgttctccaggacttatcagagaacatacagctcaataggacatggaataattagccccaaacagaagcttcttccataaaattcagttaagtatttcctcttagagaatgcacttcaaaatttggttgtgcgggagttttgcccagccaggtgcagctcaaagctcctagaatgtgagtcaaagaccaactccttccctctctcccagctgctttcccatccaaaccactatattcatccactttgttaccatccagaatctagcccgtgcttacaattggtcaaattgcacttgagataacctagttagaatgcctttttaatggagtcagctctggctctccctgcctggcagaaaagcacctggccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaagaaaagcacctggccagtggcttctgggtcacccttcctgggaaattcagccttatcgctcaggaaacccttgcagatgatgggtgtccatcacctagatcttgggctgtgttcaacagcattgggcaaaaacacaggacaccttccattccagccccaggtggagattcctctctcttcatccccatcctaaagaaactgctcagggtagcattccattccaggcttttctctcaccctctgagaatctggccctggacccaccgggcatcattagaatcagctccttcagaaggaactgcaggttcccagatcccaaattgccccagctcagggcatttatactcaccactctcacctggaaccccacaccctcacccctgtcttacatttccactacatcctagaggacttctcgccaccttaattacatgactgcagctcctagactctatgaccctatgggtagacgtgagtctggcttaccttagaatccccactactaccagggccttccacagagcagatgctgagtgaatggtaaagaaatgagccagtgaacaggaagaattatttattcagatttaatttcttttgcattctcaaagaagcaaaaacatacacatatttttaattttacataatagactgaggtataaggcaagaattaactatcttttgagttccttgtatcatgtattttactgctaattcgttcacaatataggcaaatacatattccactgctgttattatgtgacaactcacaaaatggaatggatttcccaatctgaataaaaaacaggactcttacccctaaactatataaacagcactatgtgtgactactgtcattcataaacttggatgctgaagttcatccaaccatttgttaaaaggaacatttgaacaattccaacaggaaacaaagataaatctcaaagtcatccaacagaacagaaactcactgctaagaatgctgactgctctcttcaaagaggcaggaatgggcctcatatcacacgaggcagtggaagctaatggatggggccctggaaggtgcactggcccagaccccctcccactggccctggctgcaacatgtgctgagactcactcttctccctctctcaaagcccgttcatgcaggggtgggtaggaaatgtgaggttctccaccgatctttagtgtatggtgcaggactttcacatagctggtttcaatgagggcccttggaccccacaggaactcgtagcatgcaggatcactgccgggcacctgccggtactccaggtagttttcctgcaccagatcttgcatgagcagcttcctgggatgtgcgaagacactgtcctccctcccctcaaacacctccaacatactcagctcctcccagattttctcctcaggggcacagtcgccctctattgcgattatggccaggacgattatcaggaggcctgtcttgggcatgacctgattgtcgcccagcaggccatcgtaggagaggcccaggcaggtgacaaggatgtacaagtggctgatggggaccacttccaccacctcgatgccaaagaccagctgcaagtactcggaggctttgctgaagatcacgggaaagaagtcctggcaatttctgaggacactctccagcatttctgcctttgtgaccggctccctggctcgatacttgaggagcagaaaatgaaccaactcaaccatcttcctactgattgctgcttggaactcggactccaggtcgggaaacattcttggcccctcctcttcttggttgctggagccctcatcggattgtctccaaagagtgtagttgatggtagtcgagaagctggaggctccctgaggactgtggggaggactcggtgagtcggcagcaggcacctcccccagggtaacttccactagagtagaagaggaagaagcggtctgctgctcctcagtagcaggagcctgcgcacccaccaggcccagggcctctcctcgggcctcaaggccttcttcaggcttgcagtgctgactcctctgctcaagaggcatgatgactctggtcagggcagcaggcaggagtgcgggcaggagctgggcaatgaagacccacaggcctggggagagaaggagcgtgtgtgaggccttaggtgagaactgaactgaaccttggaggctctgacaaaggcttacttacagatcttctccttcaatgctcctccagtgcctcgggtcctacttgtcagcctgtccccctcagaacctgaaggaggaagtgggagggcacctcagggtacagccggccagcacatgctcaggctgcaggactgagaatagggagggtgaggccaggccctctggagtcccatttgttctgggcgggtggggcccttggtgtgcattccaggcaaaccttcagtgttggcactgtctgcgtcccctctgctctgtgacctgaggacactgactcagaccaaggcctcactgcctggttcctggagctcctgattcctgggagaggaatgcacgggccttcagtgtgcagactgcaagcacagccacggattcccagaagtctcagcagggttggccagactccgtgaggtccccactctacttgggtggagggtcccctctgtgctcactcagggccctcacctttctccttgtagggcctaatcccacccttttgctggcttgagaatctctcatgtcaagaactcacatccctgatatggtacagaaggagatgaggggacccacatctggccatacgtgaccaggtcctcccgcgaaggacaacgagagatgtccaaattcattggagtccaggtgtcctgggtgacgagtccgcttggtcctcacgtccactcctggcagggcctgagaccctccctctactgacctgactccagccccttcagaccaaggcctccccttccctgacatcaaagatcccaggataatggagggacttcagctgacagccctgcccagggtctctgaagtaaccgcaggggcagggcagatttctatggggccccctgtctgcattctggcccaggagtaccctcaatcctacctcaggctctccacctggatgcttggcagatcctagaaccactgcatctgtcgaccagatgggggcccctgtgttgacctgagtcaccttctgaaaacaaggtcatcaactccctgagatctggaaacagaagtgaggaggggccacatcctgttacccccacgtgcgttgtccagggctgacccctttggttctagggtgaacgttatgatggcctcctgtgggttactcatctttactcctgccagggactgccctttctcaacccccaaccccctgaaatgagcagacagctcctctttacaccaacaccttatctccctgagggttccccaacctcctgcctgtggtacaaatgagattgtcacttagggccatccctgatcaggttcccccagagctaagaacaagggacggccagactctgtggcatcccttctttctgggccgggggtatccccagtcctcatgaagggggcacaccttgggtccggcagatcctgggattcctccctctgctgacctgaagtcccagccctcagaccacagccctcaactctctgtcaccctgaaggtgcaatgagcacggggcacattcggccactgtgcccaggatcccccagcccaaggttgccactgatctggactccaaggtcccctcagtcctccctcttcttcctccccttgactcctcgcagggctgggccccaaccccctgctgaagtgggtctgcatccctaggattcccgcggctgaatgaaaaggtggctcagtttgagacaggggtacagtgggccccctgtcctggcatgctgggtcccctaaggactccactgtcttccaggagggcctgggcccttcctctgcatcccaaaggccatactcacgagacccaaccccttccctcccttagccgtacatgtgaacgtcaggatccgcgtgcttggccgccattcccggagcttccgtgggttgattgcaggggcaaagcccggattctgccaggatggtggtgggggaggagatgggaatggggtttgggggtggggttggtgtttgagggatgggggtggggttggtgttgggggatgggattggtagtgagggtagggggtgggttgccctcagtcccctcttggggtcctgaccttgattcctggctgagtctgggccctgagcacttctaaccagccctgccctggtcacacaaagctcttacgccagagttccctgcggttaaagcggcggggggtggcggggtgaggtggtggcgactcagcctgagaagtcttcccctgcagggtggtccaggcccggcagcagaggcagcgctggattattgggggccctctgtctggggtgaggcccgcctcagtcctccctcggcgtcttaccttgcctcctcacggagcctgcgcctgcttccctccgccgacgtcaggccgttgctcagggcgagaatctcgctgtcctctgacctccaatgcgcaagtcagtggcgtcacatccgggcccgtgacttccctgggttcacggcaagggtggaaccggattctgcccggatggggatctggatgggggggtgggggtaagcatgaagatggtgttggtgtaggggtagggattgggacggggatcctgaggctgtagatcctggtggggtcgggggagttgggggtgggaggggcctttggtcatccctcaaggtcctgacttggatgccagactgagcctggaccgccatcctctgccgattgtgtctgctcccctcagaccaagtctctgactctgagtcggcccgaagtggcattggggggaggggtgtgctcggggtgagatcattgccagtgtgtaccagggctgacaagaggggctgagctggattctgtggtcccactatgtgggtgagggtggatcctcagtcctcactcaggagggtcctcttcctcactcctggctgtttgatgaaggaatgggtgggagatgctctgtttctgtcacctctgagcatctgcgcatctgcgcatctgcaccccttgtagagaatggctgcgggtgccaggccaggtgctccctgcagggcaggagctcccgcgatgatagtgacctctgggagaagacgcacaccttcccacgggggctcctccccagccagagctacacttggcaaacctttggtcctaaatgatttattctctgaattgaagaaatacggtttacatatcttctaagtatatatgtaggtagcaatatatatatttatttctatgaactaacacctacccttagtatgcatgattcactctgatatcctagtctacttccattccagtctttgtgttctgttgaaagaatttttttaaaaaacataattcctctcccactctgttggtttcaggttgttattagcagaactctggagccatgctgccttaacaaacccaattttcctggtggacactgctattacctagggctcttggcatcgtgttttcaggggctgcctcagattgtgcaatgaagtgaagtggaaaattcaaaacttttattctacccattctttcatctgccgtctaggcaggctacaaacctccccaacatctctgccgctaaccccctccaacagacactgcaagtgtcacacacaagtaccagctcaacacagtctccagtctcactctgggctttccctgttttgttgtgtagattttcttgctgatactggtgttttactttctgtttccattctataaatttacagggttgatttgggaagcagagcacagcagcccaaatttgcttgtaatgtcggcggctacaggtaaggcactaaattgtaaataatttaagctgagtttacatttttacactgttgtgttccccgtgaatgaatatgttatactcctctatggatttcaagctcttttttcctgaatatgtcagtatacttcggtagttgcctctataaacaacttatacatttttattaggcttctattcaggtaattcttggattttgttgctattgcaagtggcatattgtctatcaattgttgtagttagttattgctttcgtgaggtgaagattttgattttgctgtagtaatctgttgcacacctcgttctgaaggccgatgcacttgaatattccgcataccttttcctttgaattttcaagatcgataatggtattatcactaaacactacatgtttttccaatgttcataccactcactcatttcggtacttacagctctttgtgtctcaatcctgatttcaaatgtagagataataggctacatctacttctcgttcctgacttgaatgataattcttcgaacatttgacatttaagtatgtttgctgttgattttaggaaatggaagttctctttcagtataggttgcctaaatattttcttttttaccatgaattcatattaaatttatttaaaaagctttttctgtacccgttggcaggatcaaatttttttctcttccattttgtatgtaaggaatcacaatgaaacagatgttttttctaatgttaaatcatattttatttccttgggcagagcctgtttattcgtttaatgtactactaatttatgtaggatatttactgctgtgtaagagagcttacttgatgtgttctttttccatcaggggaggtatgtggtcctcatctggtttttaaatccaggagggctagcctgggagaatgaactgaacaattgtcagtcttttgtatgttctggaagagttgatataaggcggtggttagttttccctgatcatttggtaaaattggcctccaaagctgtctaacctggaatgtttgagggtggcttgagctttgaatattgtacagtttctgttgtatagttaaagttttcttttcctctttggatcagtttggttactgatttattttatttctacaaagtggtcagtttcatttaggatttcacttttaatggcatatttatgataaaaaagttttattagggaaagccttcacacatacagaataacaggaacgaatataatgaacccaggatacttgataccgagcatgaacatctttaaatacacagcaaatctggttccagttaaacactcgcctacctgcatatgagctgctggaataacgtggagtaaatctaaggcattagaccatttcatctctaaataacttaatatgcatttttaaaagataaggatttttttaaaacaaaaagccgatagttttcatatctaaaaaattaaataaatgattatcaaatgttcaactatgttacacacttatctggccaacttaaactttataaaatatatatttctttgatggagtacaaaatgtgttaacttttccccccacttgcttcattgtggtggtttcatatatctattatacaactaggtgtgtgtgtgtgtgtgtgtgtgtgtggaacattctacctgccgtcccgtgattctccaacctcttaagttacttttaaactttacatacattaagcttcactctttgtgctgtaaagatctatgggttttgacaaatgcctcgtgccattgtcttagtccgtttgggcttccataacaaaaatagtgatagactgggtggcttatagacaacgcaactttatttctcacattctggaggttgggaagtccaagatcaaggtgctggcagatttcatgtctggtggagtcctgctccctagttcatagacagctgccttttccctagatcctcacatgcaagaagggataagggatctccgtggagtctgttttataaaaacactaatcccattcatgaggactctgctctcatgatctagtcattctccaaataccccaccttctgcctaataccatcaccttggtaattcagcagatgaattttgtggcaacacaaatattcagaccaaagcaagcacggaaccaccattgcagtattatgcataccagtttcactgccctgataaattcccttgtgcttgtcggataaaccccatggccaccactgataggtttttcatctttataattttgcattttccagaatgtcatataaatagaatcttatactatgtagcctttttagactggtttctttcacttagcataatgaactgaagagtcatgtataactttgtgtggcttggaacttattccttttcattgaggagtagtatcaatgtctggttatatatatatatatatatatatatatatatatatatatatatccattcaccaaatgaaatacattttggatgcttctatttttggtgattatgaaataagctattgtatacattcatatacaaatttttatgtagacataagttttcaaatcaattgggtaaattgattgagtatggctgctgaatcttgtgctaagtctattttcatttttttaagaaaacgccaaactgccttccaaagtggctgtgccattttgcatttctaccagcaatgaaggagagtttccgttgctccacatcttcgctggcaattgttcttggtcttgtattctttgttttggttttctatggattttggacattctgataggtgtgcagtggtatcccattttagtacacaattatctaatgccaaagggtgctcagtacttttattatgcttatttgccatgtgtatatcttcttttgtgtagtgtgtgttcagatctttgactattttcattttttctatcattgagctttaagaattcgcatatattgtagagacaagttctttatcacatatgtgtaccgcagatgttttctgctagtctgtggcttctgttttcattctcttaacattgtcctttgaagagcataagatttttattttaataaaatcaacttggcaaatttttctttccttgatcatgcttttggtgttgaatttaaaaactcatcaccaaactcaaagttatgtggattttctcttatgttttcttatagaggttgtattgtttttgcatttttcattagacctatgatgtatcttgagttagttttcatggaatatgtaaggatatgtccaggttattataatttgtgtataggtgtctaattgttccgacaccttttgttggaaaacctgtactttcaccattattgcctttgttgtgaatcacctgactatatgcgtgcaggtctatttctgagctctattctgttttattaatctgtgtgtctattctttgctaatgcttatgtcctccaccaaattcatattttgaagccctcagccccagggtgtctgtatttggagatgaggcttctagggaagtgattaatgttaaaagaggccataagggtgggaccttgatcccatagaattagtttggttataagaagggagaagagacagaagaaagtacttttgtgcctacatgacctttctctctctctctctctctctctctctttctctctctctctctctctctctctctctctctctctctctctctctgcacatgcacagaggaaaggccaagaatggacagattaataaagggccatctacaagccacgaataaggccatcaccagaagccaaccccgccagtccttgatctaggacttccagacttcaaaactgtgagaaaaaaaataaatttctgttgttttagctactcactcaatggcattttgttatggcagcctgagctgacttaagacataacttcaggtgacacaattttttttttgtttcctcctagaaaaaaaaaaagtaattttgacatttaaagtctgtagttcattttgagttacatttctgtatggtgcaagatatgtgcaatggctagtactatgtgtcaacttgtctaggctatactgctcagctgtgtggtcaaacagtagtctagatgttgctgtgaaggtattttgtagatgtgatcaacatttacaatcagttgattttaagtaaagcagtttaacttccataatgtggatgggcctcatccaattagttgaaggtgttaagagaaaagaccaaggtttcctggaaaaggaattctaccacaagactaacataaaaatgcgctgtgagtttctagcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaagaggcgaggaagtggaaggcatcctctcaaccctggcccagaagccctatcaaagtgaacggcccacccaagctctgactcctaccctgtcctcccctggcacaacccccaccccagcctgcaccatttctctatgaagcccctgttctcacccctcctccatcctcttccccaaaccagtgcccttctttgatctccctgtttccttccaggttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaagtgaacatgttgcaaaatgatgtgtgtgtctgtgtgtctcaaatggtaggggtagggagtaaggggaaagaggtgggagtgtgggaagggaggggggcatcctctacaatttctctaattcaacttgctcttcgttctttggtttcctagggtgaaacttttggttattgattttagatttcattttctaatataaacatttaaaatatgctatatatttccctcaaggacacactttagcagaatcccactttttgtatgtacatttttactttcattcaacttaatgtatttttaaaattctcctgggactccctctttgacccataggttatataggagcttattttaaaatttccaatatttgggcatttttcagatatcttggtgtttggttttgagtttaattatattatggcctaagaagaggctatctattatttctattcttttcaatttgtaagctttgtttgatggcccagaataccatctatcttgggagatatttcatgcacacttgagaggattgtttattctgctattgttgaatgcggtgcttttcttattgttttatttagtcagagtagttaatggtgcttttcaggtcatctatatccttcctggttttctgcttactttttctcctaagtactgagaaacaaatcaaagagttttgagaaatgtttagtcccatgaaaccacaaccacagtgaaggtgaaaaatatattcatcctccccaaaagtttcttcctgtcttcttgttgtcaaaccatcccttcagtagaagtgatccaaggtgagcagaagtgagcatccgctgaccatgaccattttccctactaacagaggcaggtaggcacagagagcagcagttgctttcacacacaggcagcatccaggaagaaaaccagatcgatagtgtaatagaaggagagctttctggcccggacacaggctgtcgctccttttcttgcacactgccagtccccaagtctggctctgccttcctggcttccctggctcagatgggcgattcacaccacctcttcatctcccccgactccctacagactgaattaagggccttgccactttctattgttttgttgacttggtgtttcctcagcatatattgaataaaagttttctgtaggaatcaatacgtgcatggaatgaatgaaatcacctggcatgggaattctttgattcaaattatggagtctgcccttcctgggcctcctgcctacatgaagaaacccacagttccttcacctgtgctcagttgagttcagaaaccctgtggaaactaccacggagagggtcactgcagacgccttctccccaggcccaaacactgtcatggaggtgaggatgctcccaacaggatgcttcctgtattggaccccacacgtccccatcagtttaacaaggaaagctgccacctgcaatgccttgccatacaacctgctcacgtacacaccttggtccagccccctaccccagacactgtcatctggcaacatacgccagcggtcactgccctaggactcctgtcccgttctgtgccaagggttcagaagccacagaaggctatctgagacacagtggccaactggaacattttcaaggcacgtccacagccaatccttcatctgcagagtctgagctgactagtcccagggcactcctcctcccatttctcctccatgcagccccactgcccctttcaactgctcatgggcattcctggcctgtctcggcagttggtcatcagtcagcaacccactcacatagcccagcctctatagaaggtccccgggggataaaacaccagcccccagcaggcatgaagacagttcccacatctgggacgctggtgaaggtacaaaggaccactggagtgttcaagagaggtagctggcccagaatgacgcagggagtcagccaagctcttcctgagagagggaaggggattctgagggcgggaaggttgaccagcacagccctggtgcattcagccaacactcagatcacagggccccctccagctggtgatgatgttgccgggatttcccaactctattcctattcattgtcctgtcctccctcctcccttcccccttctctccctcaggcccctgaccccaccggcctgaagtctggatttagagctcggagtgacagcctgcctggggctctgtggacttggtttcgcatgtggtctctctcatggacgctagcaacggctctccccaggatcctccctggatcctccctcacgggctgagggtctcctgtctgctctcattacctggctcctcttcagtctcaccaaatccttctcaaagcagagaagaaatgtcctgtccacatttcagaattttaaatcaattgtgatttttatgagaatttgaattggtacagcacttttgtaataacattttagaaatattttaaatgttaaactattttcaccctttcactttaacccagtgtccatgttaatatatccttcttataagaaaaccatgtttgcctaaaaattcatattcagagatgttgattttattgtagttatcatacagcaaatgggaaacaacttatatgtccactaggaagaaagagtttaattaattgtggtgcatgtctactttagaattatagaaagtggtttcaaaagtgagaaagatctatctatctatctatctatctatctaccgttgtggaaagatcctacatccattttataaagtgataaaagaatatcagtatgtatatcattgttcttgtatattaaataaaaacaacatattgttatagtttatctgtcagtgagaagcctagagtcagcagtaaaataatatacaacaccgttaattgtggtgacctctgagggggcggtgggggtggtgggcgttgttaaatgtggaggagatttgtaaaggggaaaattgtgaattatctacatttctataagttttgcaataagaatatgtacaatactacattttaaataaaaaaaaattaaacctgacaaacagaaatactagccatgtcagtttaagtaactgctagccattgcaacagaacaaccacgaatggcttgccacaacacaagtttattttatgtgcaaataagttctgatgcagtttgccaggggctctccactctcacgggacccaggaatccaagctgcttccaccttgtgattccgtcatctcaagatgaagctgccatgtttgctagtgaaagcggagagaaagcttggaaatggcacactggctcccacatgcctggatgtgacaaacaatgcttctgctcctatattggtataaaggaaatgtcacatgacccatcctaactgcaaggactttactgttcccatgtgtccaggaaggagacagagacaaaatgtgtgtgagtactataccctcccccataaactgttacatagtaggtgctcaacaaaaacaactgtgattctttggtattacactacccttctcatttctaggaggagtttctgagaaggccaaatttgccgtgacattctccaactttttccagtgtcaaatatgtaactgatgttttcaaatatacgatcacaactaactgcccaagaatcttgaaagtctcggcgagaaggcttccctttgcaataccctttaatccttagtaggctgagcatttttcctccatttgattcccggtcaaaatgttaacctgtgaatttctgctaccctccacaagcctgaacacctctcgagtgcctgtaggcacaataaaggccagtattttcccgtggagcaggtaaacagacaagaaacagaaggctgcttaattattcctctttcattagagttgacatgttttcaaggaatcgtttttagactcctggaggactccagaaatttaggaattcagcctcagtaagtagatgtttgttccactgggatttcccaaggtttttctcatctagtactcatgagggatggtttgctctttgaccatttatctgtgcatgtattcagaggcgaattccaaaaggacgccctgtgaaagtctgatttcaggtatcaaggtggttccaaattcctctcacttcagggtgacatcacacaagaacccttagataatatggagaaacagactactcagccctttcagaaaacaattagagagtgtgttgaagacaaccggagtggtaaccaggtgtctaaacgtcactgtccccatgtgaatttttatatcaaaaggattgttgatatcatatggcttcctgggtgagagacgggacagccagaggacttctactgtgagaaggaatgctccctgtcaggaggtgagcaggggattctgggctgttctgtggggaccagtgaggagctgatcagcaggccctataggttccggagtcagacaggacacatggaagtgacccggggaaatgtgctgtaattctgaaagtgctggggctggacagaaatgaacacatcttgccagtgtcagctctcagggaacccagcgcacaccagccccaaatggtgtttgattctcattgtcgcgttctccaggcctgctttattacgctggcctcgaggtccttctttttgtcacctgagagacatggtgcagtgctgagaagaaaaatgaagtcgctgtcaggaggtcagcctcgggctgggagaagtgggaacagcatgggctctaaaggaattcagaacaggggtcgggttctgccctgttcctcactagccacgtgatcctgggaaatacccaggaaataccctgtttttatatcccaattcacacaccctgtgagccttggattcttcatctgtaagcagatgtgataaggactgtctagtaggacagttggagtgtatgcaacgcaggtgaagcacctgactccgggcctggtataaattagaagtttaacaaatggcggatggctgttatttccaatattttttaacccgaggccctaacactccgggattttgttgttgctgtcgttgttctccaggacttaccagagaatatacagctcaataggacatggaataattagccccaaacagaagcttcttccataaaattcagttaagtatttcctctcagagaacgcgcttcaaaatttgggtgtgcaggagtttcgcccagccaggtgcagctcggagctcctacaatctgcgtcaaaagaccaactgcttctctctctcccagctgctttcccacccaaaccaccattttcatccattttgttaccatccaaaatctagcccgtgcttacaattggtcaaattgcacttgagataacctagttggaatgccttttttaatggagtcagctctgcctctccctgcccggcagaaaagcacctggccaggggcttctgggccacccttcctgggaaattcagccttatcgctcaggaaacccttgcagatgatgggtgtccatcacctagatcttgggctgcgttcaacagcagtgggacaaaagcagacgacaccttccattcctgcctgaggtagagattcctctctgttcatcccccattcgaaagaaactgctcagagttgctttccattccaggcttttctcccacactctgagaatctggctctgggcccacccaacttcattagagtcagctccttcagaaggaactgaagtttcccaaagcccaaaatgccccagctcagggcactgacactccactactctcacccggagcgccacaccctcacccctctcttacatttcctctacatcttacaggacttctcaccaccttaattatatgactgcaggtcctaggctctacagccctatgggtaggcgtgagtctggcttaccttagcatccccactactaacccagggcctcccacagagcagatgctgagtgaacggaaaagaaacgagccagtgaagaggaagaattatttattcagatttaatttcgcttgcattctcaaagaagtcaaggaaatcctggtttgcatatttgtttaattttacagaatagattgaggtacaaggcaagaatcaactatcttttgatttcttgagttatctcatgtatgttattgctaattcgctcacaattttaagcaaatactttttccactgctattattatgtcacaattcacaaaatggaatggatttcccaatctgaataaaaaacaagactcttactcctaaactatataaacagcactatgtgtgactactgtcattcataaacctggatgctgacgctcattcaaccatccgttaaaaggaacatttgaacaactccaacaggaaacaaagaataatctcaaagtcatccaacagaacagaaacccactactaagaatgctgactgctcgcttcaaagagtgaagaatgggcctcacgtcacaggaggcagtggaaactaagggatggggccccggaaggtgcactggcccaaaccccctcccactggccctggctgcaactcgtgctcagactcactcttccccctctctcaaagcccactcatgcaggagtgggtaggaaatgcgaggtcctccactgatctttaccatatggtgcaggactttcacatagctggtttcaatgagggcccttggaccccacaggaactcatagcatgcaggatcactgccggggacctgccggtactccaggtagttttcctgcacgaaatattgggtgagcagcttcttgggatccccgaagatactgtcttccctcccctcaaacacctctaacacactcagctcctcccagattttctcctcaggggcacagtcgccctcttttgcgattatggccaggatgattatcaggaagcctgtcttgggcatgatctgattgtcacccagcaggccatcgtaggagaggcccaggcaggtggcaaagatgtacacgtggccgatggggtccacttccatcagctcgatgccaaagaccagctgcaaggaatcggaagctttgctgaagatcacaggaaagaagtactgccaatttccgacgacactccccagcatttctgcctttgtgaccggctccctggctcgatacttgaggagcagaaaatgaaccaacttggccaccttcctactgagtgctgcttggaactcagactccaggtcagggaaggtgcttggcccctcctcttcttggttgctggagtcctcataggattggctccagagagggtagttcatggtagtggggaggctggaggctccctgaggactctggggaggatctggtgactcggcagcaggcacctcccccagggtgacttcaactagagtagaagaggaggaggcagcctcctgctcctcagtagcaggagcctgcgcacccaccaggcccagggcctctcctcgggcctcaaggccttcttcaggcttgcagtgctgactcctctgctcaagaggcatgatgactctggtcagggcaacaggcgggagtgtgggcaggagctgggcaatggagacccactggcctggggagagagggagcatgtgagagacctcagctgagtactgaatggaaccttggaggctctaacaaaggcttacttacagatcttctccttcagtgctcctccgggggcctctggtcctccaggtcagcctgtcccctcagaacctgaaggaggaagtgagagggcacctcagggtacatccggccagcgcatgctgaggctgcaggactgaaagtattgagggtgaggccaggcgctctggagtccatgtgttctggggcaggtggggcccttggtttgaatccaaggcaaaccttcaccgttggcactatctgagccccctctactctgtgacctgaggacactgcctcagaccaagtcctcactgccttgttcctggagctcctgattcctgggagaggaatccacgggcccccaatgtgcagacagcaaacgcagccacggattcccagaactgtcaggagggttggccagactctgtgaggtccccactctactggggtggaggatcccctctgtgctcactcagggccctcacctttctccttataggacctaatccctcccttctgctggcctgagaatctctcatgtcaagaactcacatacctgatatggtacagaaaaacatgaggggacccacatctggccatacattcccaggtcctcccggaaaggacaacgagagatgtccaaatttattgaagtccatgtaccctgggtgaggagactgcttggtcctcacctccactcctagtagggtctgagagcctccctctactgccctgagtgcagtcccctcagaccaaggcttccccttccctgacatcagtgatcctaggataatggagggacctcagctgacagccctgcccaggctctctgaggtaacagcaggagcagggcagatttttatggggcccccagtccgcattctgtcccaggggtaccctcaatcctccctcagtctcttcacctggatgcttggcagatcctaggaccactgcatctgtccaccacataggggccccttgggggtacaccttgggccctgcagatcctgggattcctccctctgctgacctgaagtcccactcttcagaccacagccctcaactctctggtcaccctgaaggcgcaatgagcacagagcacatttggccactgtgcccagcatcccccagcccaaggttgccactgatctggactccaaggtcccctcagtcctccctcttcttcctccccatgactcctcgcagggctgggccccaaccccctgctgaagtgggtctgcatccctaggattcccgtagccgaatgaaaaggtgcctcggtttgagacaggggtacagtgggccccctgtcctggcatgctgggtcccctcaggactccactgtcttccaggagggcctgggccctttcgctgcctcccaacggccatactcgcgataccgaaccccttccctcccttagccgtagatgtgaacctcaggactcacgtgcctggccgccattcccggagcttccgtgacttgataccaggggcaaagcccggattctgccaggataggggtgggggtggggatgggaatggggaatgggggatgggggtggggttggtgttgggggacgggaatggtggtgagggtggtggttaggctgccctcagttccctctcggggtcctgaccttgattcctgccacagcgtgggccctgacctcttctaaccagccctgccctggccacattaagctctgtccccagagttccccgtggctaaagcggcgggggtcggcggggtgaggtagtggcgacccagcctggaagtcttcccctgcggggtggcccaggcccggcagcagaggcagcactggattatttgaggccctctgtctgaggtgaggcccgcctcagtcctccctcagcgtcttaccttgcctcctcaccgagcctgggccggcttccctccgccgacgtcaggccgtcgctcgttgctcagggcgagaatctcgcggtcttctgacctccaatgcgcaagtcagtggcgtcacatcctggcaacggtactaccctgggttccgggcaggggtggaactggattctgcctggatggggatcggatgggggtggaggtaagcatgaagatggtgatggggcaaggggtaaggattgggacgggggtcctgaggctgtagatcctggtggggtcgggggagttgggggtgggtgggcggggccttcggtcatccctcagggtcctgaagttgatgcctggctgagcctggaccgccatcctctgcagattgcttctgctcccctcagaccaagtctctgactctgagtccccctgaagtggcattgggggaaggggtgtggtctgggtgacatcactgcctgcgtttaccagggctgacaagaggggctgagctggattctgtggtccctctatggtgtgtggggtgggggggcggtgtggaccctcagtcctcactcaggagggtcgtcttcgtcacctctggctgttggatgaagtgatgggcaggagatgctctgtttctgtcacctgtgagcatttgcacagctgcaccccttgtagagaatgcctgcgggtcccaggccaggtgctccctgcagggcggggcggcagctcccgcggttgtagtgacctcctatttcagtctttgtgttctgttgaaagaatttttttttttaaaaaatgtaattcctctgccactatggtggtttcaggttgttattagcagaactctggagtcatactgccttaaccaaccaaattttcctggtgtcctgctattacctagggctcttggcatcgtgttttcagaggctgcctcagattgtgcaaagaagtgaagtggaaaatttcaaacttttattctacccattctgtcatctaccgtgtaggccggctacaaacctccccaacatccctgctgctaaccccctccaaccaacactgcaagtgtcaaacacaagtaccagctcaacacagccttgagtctcaccctgggctttccctgttttgttgcgtagattttgttgctgatactggttttttatttactgtttccattctgtaattttccaggtttgatttgggaagcagagcacagcagcccaaatttgttgtaatggcggcggctacaggtaaggcactaaattgtaaataatttaagctgagtttacatttttacagtgttgtgctccccatgaatgaatatattatactcctctatgtaatttcaaggttttttttacctgaatatgtcagtatacttcgacagttgtctctataaagaccttatacatttttattagacttcttttcaggcaattcatgaattttgttgctattgcaaatggcatattgtctattaattgttgtagttagttattgctttcgtgaggtgaagattttgattttgctgtagtaatctgttgcacacctcgttctgaaggccgatgcacttgaatattccacataccttttcctttgaattttcaagatcgataatggtattatcactaaacattacatattcttccagtattcataccacttactcattttggtacttatagctctttgtgtctcaatcctgatttcaatcgtagagataatagcctacatctacttctcgttcctgacgtgaatgataattattcgaacgttttgcatttaagtatgtttgctgttgattttaggaagtgcaatttctctttgaatataggttaaatactttttttttttttttaccatgaactcatattaaatttctttaaaaagctttttctgtacccgttgacgcaatcaaatttttttctcctccattttgtatgtaaggaattacaatgaaaccgttttttttttttcccctaatgttaaaccgtatgttatttccttgggcagagcctgtttatttaatatgctagtaatttacgtaggatatttgctgctatgtaagggagcttacttaatgtgtgctttttttcccatcaagggtgggatgtggtcctcatctggtttttgaatccaggagggctagtctggaagaatgaattgaacaattgtaaatattttgtatgttctagaagagatgagataagatggtggttagttttccctgatcatttggtagaattggcctccaatactgcctaacctggaatgtttgaaggtggcttgagctttgaacattgtacagtttcagtttttatagtttaattaaagttttctttttctttttggatcagtttggttactggtttattttatttctacaaagtggtcagtttcatttaggatttcacttttaatggcatatttattataaaaaaagttttactagggaaagccttcacacatacagaataataggaactaatgtaatgaacccaggatactagatacccagcatgaacaactttaaatacacagcaaatctggttccagttagacacttgcctacctgcacatcagcttctggaataacgtggagcgaatctaaggcattagaccatttcatctcgaaataactcaatatgcatttttaaaagataaggacgttttattaaacagaatcccaatagttttcatatctgaaaaattatataaatgattatcaaatattcaactattttacatgcttatctggccgacttatactttataaaaaacatatttctttgatggagtacccaaatatggtaactttcccgccacttgcttcactgtagtggtttcatacatgtataatacagctaggtttgtgtgtgtgtgtaacattctacattctgtcccatgattctccaacttcttaagttacttttagactttacatacattaagcttcactctttgtgctgtaaagatctatgggttttgacaaatgcctcgtgccgttgtcttagtccctttgggcttccataacaaaaatagtgtagactgggtggcttataaacaacacaactttatttctcacattctagaggttgggaagtccaagatcaaggtgctggcagatttcatgtctgatggagacctgctccctagttcatagacagttgcctttcccctatgtcctcacatggaagaaggggcaagggatctctgtggggtctattttataaaaacactgatcccattcatgaggactctgctctcatgaactagtcattctccaaataccccaccttctacctaataccatcaccttggtatttcagcagatgaagtttgtgggaacacaaatattcagatgaaagcaagcatgcatccaccattacagtattaccatactagtttcactgccctgataaatcccctgtgcttgtcagataacccccttggctgccactgataggtgtttcatctttataattttgccttttcctgaatgtcatataaatagactcgcatactatgtagcctttttagactggtttctttcacctagcataatgaactgaagagtcatgtataactttgtgtggctcagaacttattccttttcattgaggagtagtagtatcattgtctggttgtaccatagtgcgtgtgtatatatatatccatccaccaaatgaaatacattttggatgcttctatttttggtgattatgaaataatcttttgtatacaatcgtatacaaatttttatgtagacgtaagttttcacgtcaattgggtaaattgattatgactgctgaatcttatgctgtgttcagttttttaagaaaacgccaaattgtcttccaaagtggctgtaccatgttgcatttccaccagcaatgaatgagagtttctgttgctccacatcttccctggcaattgatcttggttttcttttcttttttttttttttttttgcttttttatggattttggacattctaataggtgtgtagtggtatctcattttagtacacagttatctaatgagaacggattctcagtacttttattatgcttatttgccatgtgtatatcttcttttgtgaggagtgtgttcagatctttgcctattttcatgttttttctgtcgttgaactttaagaattcgtgtatgttgtagagatatgttctttatcacatatgtgtaccaccgatgttttctgctagtctgtggcttctgttttcattctcttaacattgtcctttgaagagcacatgatgtttattttaataaaatctacttggtaaatttttctttcattgatcatgcttttggtgttgaatttaaaaactcaccactgaactcaaagttatgtgaattttctcttatgttttcttatagagggttgtatagtttttgcattttgcattaggtctgtgatttatatcgagttaatttttctggaatatgtaaggatgtttctaggttattataatttgcctgtagatgtctaattgttcaggcaccttttgctggaaaaactgtactttcaccattattgcctttgttgtgaatcacctgactataagtgtgcaggtctatttctgagctctattctgttttattaatctatgtgtgcattctttgctaatgcttatgtcctccaccaaattcatactttgaagccctcagccccggggtgtctgcatttggagatgaggcctctaaggaagtaattaatattaaaagaggtcataagggtggggcctcgatcccataggattagtatggttataagcagttagaagagacagaagaaattacttgtgtgcctgcactagctctctctctctctctctctctctgcacatgcacagaggaaaggccaagaacggatatattgagaaagggctatctacaagccaggaataaggccgtcaccagaaaccaaccctgccagtccttgatctgggacttccatacttcaaaactgtgaaaaaaaataaatttgttttgtttcagctactcagtccatggcattttgttagggcagcctgagcttactaagacataacctcaggtaacacaatttttttttgttttctcctacagaaaaaaaaaaaacccataattttgacatttaagtctgtggttcattttgagttacatttttgtatggtgtaagatatgtgcgatggttagtattatgtgtcaacttgtctaggctatagtgctcagccgtgtggtcaaacagtagtctagatgttgttgtgaaggtattttgtagttgtgattgacatttaccatcagttgactttaagggaagcagtttaatctccataatgtggatgggcctcatccagttagttgaaggtgttaagagaaaagactaaggtttcctggaaaaggaattctaccgcaagactaacataaaaatgttgtgtgagtttctagcctgctggcctgcctcacagatttgggatatacaagacctcataatcacatgagataattccttatgaaacctttatctttctttctctccctccctttttacatagatagatatgtaggtaggtagctagatagatagatagacaggaagaaagcaattacggattgaaattcagttttgcatatagatatccagttgttctagacccagttgaatacactatcatttctctcctcgaatcttcatttgtatctttatcaatatttgacttatatatatatgcatatacatgtggatccattcctggactttactctcttctttttatgtgtttctaaatttaggacaattccacactatactgattattgttagttaataaaccttcaaatgaagtaggggaacccctctgtatttattccttttcacacagctgataaagcataccagagactgggaatgttacaaaagaaagatgtttattggacttgcagttccacgtggctgggtaggcctcacaatcatggtggaaggcaaggaggagcaagtcacgtcttacatggatggcggcagacaaagagagagagagcttgtacagggaaactgccgtttttaaaaccatcagatctcttgagacttattcactatcacgagaacagtatgggaaagacccaaccccatgattcaattatctcccactgggtccctcccacaacatgtgggaatattgggagctacaagatgagatttgtgtggggacacagagccaaacaatatcattccacatgtggcccctcccaaatctcatgtcttcacctttcaaaaccaatcctgccttcccaacagtcccccaaagtcttaactcatttcagcgttaacgcaaaagcccacagtccaaatcttgagaagttgtcaaaggacactcagttttcttcagttaataatgtaaaaggactgcactgacgtggttaaattcccaggactctcagttctttaggaatggactaaatatctggtatcgtcacttacaaaagtgtcttgaacttgatatagtttatgttcagaaattggttcatattttttatttttatcttttaattcaattttttttcatgagctttttgaaggcccccggatatgcaccctgtataaaggagaaaaattctcgggactactaattttgaccgaaattattgttgatttaatttatacaaacacaaaaggtgatacaaacatttttatagcacctaatgaacatatttgtgaaataaatgcattcaaaaacaaactaaaacagaaaagaataaaaatatacaataaaatagtacacagcaggttgctgattgtggtgacctctgaggtgcgggctgaattgtggaggaactttatacagagaagaattgtgaattatctgtattttagatttcttttgcaacaagaatataggcacaattatcttttaaattacaatatctaaataagcctaacagcaaaaatagtagctgtgtattagtcagttaaagtaactgaagtaactgctagctgatgcaataggcaaaccctggaatttgagtgacatgacaaaacacaagtttatttaatgtgcacatgagtcctgatgtggtttgacagggcctctccactctcccgtgacccaggtatccaggcagcttccacctcgggattccaccacctcaacatgaggctgccatgtttactattagatggagggagaaagcatggaaatggcacactggctctcagatgtctagatgtgacaaacaatgcttctgctcatgtttcagtggtaaggggttgtcacatgacccttcctaactacaagtggactgtactgttcccatgtatccaggaaagagaggaagatgagatgtgggtgagcactatagtctctcccataaactgttgcatagtaggtgctcaacaaaaaggaactattattatttgctatgacaacagccctcttcattgctgggaggagtttcggagaaaaccagattttctttacgttctccaactttttttaagtgtgtactgtatgacagatgctttcaaatacaggatcacatgtagttttctaaggatccagtatacctcagcacctcgtgtgatatactaacttcttcactcactagtatagttagatatactaactatcttcacttactaacacttttctgcactgtcatttgcaataatgtctgaaaccttagtaggctgagaatttctcattcttttaattcatgggtaaaacctcaacctgtgggtctctgctaccctcctgttacctgaacgtctgttcagatgccattagacacattgaaagctatgtctttcctgtggggcagatccacagaccagaagtagtgccaagagagttctttttttcatttctgattttttttccatttctaatcagagctagcatgcctaccgaggaaccacttttcgtctcctaggagaactttagggttttaggaattcagcttcagtagatatttgccccacagtgattttgacagtccttcctcatctgtcacttatgaaggagatgctgtgaactgaactgtgcccccacccccaccaaaactcatatgttgaaaccctaagacccagtgtgatgtatctgtagatgaggcctttggacgtaattagagttagatgaggtcattaaggtggaaccttcgtgatgggattaccgctcttataagagacatcagagagcttgctcgcattctctccttctgccatgtgcagacacacagagaaggtagctgtctacaagccaggaagagaccctcaccaggcatcaaacctgctagaaccttgatctcaaacttcccagcctccagaaatgcgagaaacatctacctatttgtttaagccacccagtggtactttgttatggtactttgttatggcagcctgagctaatacaagaggctttggcttttgaccatctatgtatgtgctctgtggccagtttccaatgagacagcttattaaagtcctattgtaaatataggatggtttcaaacactttctaacttcagggttgtatcccaggaactgatatattataagtcaaaatcagacgctactcaccagctgacttggaaaacattttaagaatgtgttgaagacatccaacaggatgatcagatgtctgaaggtctctattcaaagtcaaatgtatttttgctattagaggggccccagtgtgaggaacagggacagtcaggggacttctccagaaagtagaactgttctatgttaggagaagggcaggtgactcttggctgtcccactggaagtagggcacagcctttaaaggatgcaaccatgaagagcttagcagcaagctcgattccagaattggacaggcaggcacatggggcaagaccattgtggaagggtgctataattcgggaaagtgctgggaatgcacagaaatgctggcacctggacagagttggctctcaaggaaccacagacgattcctaaattgtgttggttctcattgtcaccttccttcatgtcttagtcatttcatgctgctgtaacaaaatgctatagactgggggtcttacacaacagatgcttattttctcccagttctggaggctgggaagccaaaagtcagaatgccagtatggtgggtgtctggtgagggtcttctttctggcttatggatgcccaccttctctgtgagtcctcacatggcagagagagaaagagaaaaatgtgcaagctctctggcatttcttcctataaggacactgatatggtctggatcagtgtccccaccaaatctcacgctgaattgtaatccacagtgttggaggtggggcctggtgggaggtgattggatcatgggggcagatttctcattaatagtttagtaccatcaccttggtactgtgctcatgatagtgagtgatttctcacgacatacggtcatataatagtgtgtggcaatgccccccccgtctctcttgctcctgctttcaccaagtgaagagcctgctccttctttgcctactgccataagtaaaagctccctaaggcctctccagaagcagatgctgccacgcttcctgtacatcctgcaaaccgtaagccaattaaacctatttttttttaataaattacccagtctcaggtatttttttatagcaacgcaagaatgaacgaatacagacattaatccaatcatgagggcctacgctctcaggagctcatctaaccctaattacctcccaaaggccccatctccagaccatcacattgggacttagagcttcaacatatacatttttttttttttttggaggggagcacatttcagtccatagcacttctttaggcatactttttgtagcttgaccacagggtccttcttttggttgcctgagagacgtggattcctgagaagtaaatagcaagacgaaggtctgcttcaggttgggacgagaaggaatgacatacactcagatgaattcggaccatgtgtattagtttgctttggctatcataacaaggtaccacagactgggggagcttaagcgtcagaaatgtattttcccagtcccggaggctacaagttcaggctcaaggtgtgggcagggttgagttgtcctgaggcctgtctccttgacttgtagatggccattctcttcctgtgtcttcacatggtctttcctctgtgtgtgtctgtgtcctaatgtcctcttcttataaggacaccagtcatattggattggggcccatcctaatctagcagggatgcaatcccaaccgtgttgcttattagccatgtaattatggggaaatcatcaagccgcatgagcatcaggttcttcatctgtgaagcaggtttgataaagtctgtcttataggacttttggagtgtgtgcaatgtaagtaaagcacttggctcagggcctggcatatattagatcgttaatgtttggcagttatttgtgttactatttggaactcagatcctaccatagttgcctctgggaattttgttgttgctgttgttattgttatctaggaaacctcagagtacgtagcacaacagtacagagaatagaataccaactcagcccaaagtgttgcttcatagacaaaacacagtagaatttccctcctagaggatctattgtttaatttgtgtgtggaggagtcttcttcagctggattgcagctcagtgttcctggaacgtgagtccaggaccaactcttttcctccctctcagctgcttttccatctcaaccactattttcattcatataatcaccacgcaaaatctagcccatgctcaggaatggccaaattacacttgagataacctaattagaatgccatttgactagagtcagctctagctctcccactaaggcagaagagtaccttgccagtggcttctgggcctcccttcctgagagattcacccttacctcccaggaaacccttgcagatgatgagtatccatcacctagctcttgggctgtattcaaccgcactgggataagagcacaggatgccttccattcctgccccaggtggaaactcgtctatgttcatccaccaaccataatgaactgctcagagcagttttccattccaggcttttctctccctgagaatctgaccctggacccaccagcttcattagaatcagcttcctccgaaggaactgcagtttcccaaagcccaaaaggccctggctcagggcatttacactccaccactctcaccgggagcaccacacattctgccctctcttacttttcctctaggtcttagaggaaatctcaccaacttaattttatgactatagctcctagaccctaccacccttcgggtaggggtgggtctgacttatgccagtatctccagtaacacagtgctttccaaagagcagatgctcagtgagtgtttgagaaagaatgagccagtgaccaggacttccatttaagatataatttctcctacatccttgaataagccaagaaaatccaggtacacatatatggcttaattttatagaacagcacatgaataaaaagctgagaattaactgtcttttccttttatttctattttttagagtaaagtgagagcaagtttattaagaaagtaaagaaataaaagaatggctactccatagccctgagggctgctggtcgccttcttatttttatttttatttttatttttatttttttttttgagacagagtctcactctgtcgcccaggctgcagtgcagtggcgtgatctcggctcactgcaagctccgcctccctggttcatgccattctcctgccccattctcccaagtagctggactgcaggtgcctgccaccatgcccggcaaattttttgtatttttagtagagacagagtttcactgtggtagccaggatgctgtcgatctcctgacctcgtgatccaccccctttggcctcccaaagtgctgggattacaggcgtgagccatggcgcccggctggttgcccatttttatggttatttcttgattatatgctaaacaaggggtggactattcatgagttttccaggaaaaaagtggggaattcttggaactgagggctcctcccctttttcagccatatagggtaacttccaaacgttgccatggcatctgtaaactgtcgtggtgccggtgggagtgtcttttagcatgctaatgcatataatgagcagtgaggatgaccagaggtcactctcattgccatcttggctttggtgggttttggctggcttctttactgcaacccgttttatcagcaaggtctttatgacctgtatcttgtgccgacatactgtctcatcctgtgactaagaatgccttacctcctgggaatgtagcccagtaggtctcagccctattttacccagaccctgttcaagatggagttgctctggttcaaacacctctgacatttccctcctcccttttatctgagaacctttattcctaagggttgtagagggatgaagatccatcttctgtaacttcttcaggctgaataggggtgatgatattactgcctaattatgagagtcttttgaattcaggacagagaggagctcagtcagaaagcgtcagtttggtgagggtcatacacaactctgagttctgacaaaacatgttatctggaagattaataagtgttcagtttaagaaaacattgagtaagcttatcctgcactcctgcaccaagaatacaacaccagtgtattccacaacagtaaagcaaaataagtaaaattatcccaaggtaaactaagtaagaaggctttccttgaactgggcaactgttagaaccaggctgatacggggtcactatctgatttcaatatgtgcccagaactagaatattgatccagatttttacattacccatccctcttgcttcttctaaatagcagtcagggatcactgattggttcacaggaataagaaaagtgagtctaaattgcagaaaaaaactttaaaacaacgaatgaaactagaatctaataacaggtgcaccatagtttttgcaacatcatatttttttctctctccagtctcccatttttactaaagacaaatcatggtaagactggtttgttttattatacttggcctgatcatttgtataaagtgcagcaagaataattatttttcacatacgctctttatatttttatttttattttatgttttaatagaggcagtctcccaatgttgcccagtctggtctcgaactcctgggctcaagcagtcctcctgcctcagcctcccaaagtgctgggactgcaggcatgagccaccacgcccagcctcacataagctcttttaaaactggctttgatgggccgggcatggtggctcacgcctgtaatcccagcactttgggaggctgaggtgggcggatcacctgaggtcaggagttcaagaccagccaggccaacatgttgaaaccccatctctactaaaagaaaaaaaaaattatatatatatatatacacacacacacacacacacacacacacagacacacacacacacatatatacacatatatatgtgtatatatatatatatgtgtgtgtgtgtgtatatatatatatatatatatataagattagccgagcgtagtggtgggtgcctgtaatcccagctactcgggaggctgaggcaagagaatcgcttgaacccaggaggcggaggttgcagtgagccaagatcaccctcctgcactccagcctgggcagcaagagcaaaactcggtctcgaaaataaataaataaataaataaataaataaataaataaataaataaataaatgaaaataaaaaataaaaataaatggctttcatggagctctgttccatagaaggaatctcagataagacctttttaaagctgagtccagcctggggtgggtgccgtcaaatacctctgagttgggtaaaatcctctcctcttgaggtcccaagataacttggggctcctgggcctgtcagataatgacattctttacttaccacaggtcagtaaccctgcacagggactgtgtagacaagttatgaggctagttttcccaaggggtttttattggctctataagtcaagtttgatcccttaaaggaaagaacaccattccagtcaaagccttggtaaaataaccagtttctccaattgtgtcttgttgcaaaagaaaacagattcttattgcacttatgcaaataactatattgctataagttaagaatattcacaagcagtttccaaattctagagaaattaggtagagagaaacaaatatgctctgaattttgttcacagaagtatactttactgaattgttaaaagctgtcaatagcccagaagaaaagttttcctgactccaaagtctgccagtcagtgctgccgtctatttcctttgggtcagggggtttcctcagtattgtcccttcagggttcaccggaaagatgttactggaatggggtcccagtgcagactccaaaagagggttcttggagctcgtgcaagaaagaattcgaggtgaatccatagagtaaagtgagagcaagtttattaagaaagtaaataaaagaatagctactctacgggcagagcagcctatcttttccttttatttctctgtttcatgaccccatcaatttttttgctaatgtatttcattctccaaggaaacacctattccaatgccatggcatcttgttccaaaccgcaaaaccagatgaagggcttcccaatatgttttacaaaatagcaaactcatccaaatagaacagaacacaaagacattatacactgagttcccttccacccaccgtgcctttcactagtgagaacgctgactgctctctttagagtgaagaatgggcctcatgtcacacagggtggggaagctgctggatgtagccctggaacgtgcactagtccaccccaccctccactggccctggctgcatcgcctgctgaaactctctcttcctcatagcatgcaggatcacttctgggcacctgccagtactccaggtaattttcctgcacccaatcccgggtgagcagcttcctgggctccccatagatgaagtgctccctcccagcatacacctctatcacattcagggcttcccacataacctcctctggggcgcagttgccctccgtgaagatcacacacaggacaattattaggaggcccgtcttgggcttgctcgggtcatcaaccagcatgccatcataggagaggcccagagaggtgacaaggacataggaatggccggtggggaccacttccttcacgtcgatgccaaagatcagctgcatgtactcggaggattccttgaaaatgaaagcgaagtagtcttcgtgatttttgatgacactatccaccatttctgcctttgtgactgactccttaattcgaaacttgtggagcaggacactaactaaatcagacaccttgtcagagtgcctctcggaggaaggactccatgacacttgggatgggcaaggtgattggctcctccttttcttggctgctggagccctcatcggattggttccatagagtgttatcgatggtagtgggggaggaggaggctccctgcatactctggggaggactcagtgcctcagcagcacacaactcctccagggtgcccatgatcagactagaggaggaagaggcagcctcctcctcctcaggcacaggaccctgcccacccaccaggccagggacctctccttgggcctcaaggccttcctcaggcatgtagtgctgactcctctgtccaagaggcatgatgactctggtcaaggcagcaagcgggagtgtgggcaggagctgggtaatggggatgcacaggcctggggagagagggagcgtgtgagaggcctcagctaagaaccagactttggaggaggctctaacaaaggcctacttacggatcttctccttcagtgctcctctggggcctcctggggctcctgtcctcctggtcagcctgtcccctgagaatctgaagaaagaagtgacacagcttctcaggttacagccagccagcagaggccaaggccccaaggctgagggtagggcaggtggggctgggcgctctggggtcccatccattatgggtgggtgggacccttggtatacattcagggtgaacacctcaccttgactgctggcactgcctgggtctcctctgctctgtggcttgaggacactgactcagactaaagcctcacctccaagttcctggagctcctggaagagggatcaaggggccctcagggtgcaggctgcaagcacagcctcagtcccccgagtgctgtcaggagggtgggctggactctgtcagttccctcactcttttgcatagatggccccttctatgctcactcaggaccttcacgtttctcctagcagggcctgaatcctgcccctttgctggcctgagaaactctcagatcaagagctcatatccctgatatggaacagaaggacatgaggggacccacatctggccacacctgctcagggcttccaggcaaggacagtaagaggtggccatattcagctgggtccatgtgtcctgagatgaggaacctgcttggtccacatcttgatgcctgcagatcctgggactctccctgtttacctgaggccaccaccttaaatcaaatccctatctccaagagacaccagtaaaggaagtgaggggattccatccacccactgttccctgcagtttcccatgcctgacagaaaaggcagggcagggctgggtcatgtgcattcgccgtgtggggtccacttagtcctcaccttgactcctggctgagcctgggaccctccctctgacctaaatgcagcccctccaaccaaggcctccccctccctgagaccactgatcctggtataagagagggggcctcaactgacagctctggccatgctctctgcggaaacagcaggggcaaggcagatttctgtggggcctccatctgccttctggtccagcggtacccttaatcctccctcaggttcctcacctggggtcttagcagatcctgggtccgctctgtctgttaatcagatgggggtccctgtgttggcctgagtaacccactgagaactaggtcctcacctccctgagatcccaaagccgacatgaggaggactcacatcccgtcacccctccatggggtgtccagggctgacaccaggggctgcccccttctgttctggggtggaagttccaaagttctcctgtgggttattcatctttactcctgccgggacctgccgttcctcaaccctcagccccctgagatgagcagacatctcccctttacaccaagaccacatctccctgagggttctccaacttcctgcccgtggcacaagtgagattgccacttagggccaccctggatcaggtccccccagagctaagaacaaggacagcagactctgcggggtctcttctttctgggctgggggtacctccagtcctcatgaaaggtgcacaccgtgggtcctgcagatgctgggactcctccctctgctgaccaggtgtggctccctctactggcctgtcagtgtcactgggaccaaggtcctcacctccctgagacctcccacctccaaccacatggcagaaatgagagcatgccacatgccatccctgcctgtggcctcccagggctgagaacaggggaagctgggcggctctgcaagttcccttcttctttatgatgtggaggtaacttcttaccttcagtccttaccaaacttcctccccttcactcctggaagaccctggactctatccggtgctgaccaggtgtggctacctctgctgagcggaggacgcccctcagaccaaggcccccacctcactgagacccgggaggtagaggtgagggggcaccacacggtcacccctgcgtgggattcccaaagctgacagaaggtgcaagtttcagggggccctccgctgtctgggtgtcttccaggtgttcagattgagtcccgacagggcccggctctttccctcctgctgaactgtatgccaaggccaccatgtccctgataccctcagggagaaagtggtgggacagcatcccttccccacagtcctgcccaggcctcccaggactgacagtaggggcaggtttcctaagtctgggaagaaaggtcttctgagtcatccttcagagctctgggactcctctctctgctgacctgaggccccactccccagaccacagtcctctcctccctgacaccccaaaggcacagcgagtccaggccacatgtggccactgtgcctgggacctcccagggtcgaggtccccactgatctggactccaagttcccgtcagtcctccctcttcttcctgcccttgactcccggcaggcttgggccccaccccagcctgctgacctgagtcttcatccctcagattcccaaggccaaatgaggaggcacctcagtctcaaacagggggtgggtgggccccctgtcctggggtcctgggtgccctcgggcctctctcaggcctcccttgtctcccagcagggcctgggccctccctctgctccccgcaatccgtgctcatgatatgaagccccttccctccgtcagccctggatgcccatgccaggatccacatgcctggccaccatgcctggaaattcccagggctgacagcaaggacagagccccgctctgtggagccctcaaccctctctgagggtcctgaacgtgatggctggcagagcctggctgctgccctctcctaggcagccctgccctgatcacaccaacctctgactccagagtcccctgaggcttaagtggcagagagttgggggcggcccagcctgagaagtccgcccccgggtggtcctgggttggcagcaggggtggtgctggattttttagggtcctctatcttgggttgcaacggggtgtccctagtcctccctcaacgcctcacctttccttcacacacagcccgggcccgctttcctccgccgatcttaagccacccctcaaaaccaggccctcgcttccctctgatccctgaggcgcaaatcagtggcatcacatccgggcacccggggcttccctgcgttgacagcaggggcaaaacctgattctgtcggggtgggggtggggatgggaatgggaatggaggaggggtgggggcgaggatgggggtgaagatggggatggggatggggatcctgaggctgtaggtcgtggcggtgacggtgggcttgggggtgagggaggccctcagtcgttcctcagggtcctcaccttgaaacctggcagaacctgggccctgccctctcctaaccacccctgccttggtcacaccaagctctgactccagagtcccctgtggcataagcggcgggggttggcagggcgccggggggtggcccagactgagaagtactcccctaggtggtccagggctggcagcaggggtgacgctgaattatttggggtcctctatctggggtggaggcgtcctcagtcctccctcagcctctcaccttgtcttctcacagagcctgggtccacttccctctgccaatctcaagccgcccctcagaccgagaccctcgcttctctgaccccctagccgtcacatccggccaccaagcctggggcttccttgggttgactgctggtgtcatagcggattctgctatgagtgggggtggaaatgggggtgggggtggggggtcgaggtcgagggggtgggcactctcagtcatcctcaaggtcctgaccttgatgcctggcagagcctggatcccatcctgtgtggatggtgtctgctcccctcagaccaaagcactgactccgagtcccctgaggtggcagtggagggagggatatggtcggggcgacaacattgtcagggtcttccagggctgacaggaggggctgaactggattctgtggtccctctatgtggggtgagtggaccctcaatccttactcaggagggttctcctcttggctcctggctctttgatgaagtgatgggtgggggatgctctgtttctgtcacctctgagtattcgcccagctgtaccccttgcagagaatggctgcgggtcccaggccaggtgctccctggggagctgcagtgcctgcgattgtagtggcctctgggagaagacacacaccttcccacgggggctcttccccagccagatgctgggaagaaactgcatcaactaacgagcaaaataaccaggtagcatcataatgacaggatgagattcacacataacaatattaaccttaaatgtaaatgggctaaatgctccagtgaaaagacacagactggcaaattggataaagagtcaggacccatctgtgtgctgtattcaggagacccatctcacatgtagagacacacataggctcgaaataaagggatggaggaagatctaccaaacaaatggaaaacaaaaaaaggtaggggttgcaatcctagtctctgacaaaacggactttaaaccaacaaagatcaaaagagacaaagaaggctattacataatggtaaagggatccagtcaataagaagagctaactatcctaaatatatatgcacccaatacaggagcacccagattcataaagcaagcccttagagacctacaaagagacttagacttccacacaataataatgggagactttaacaccccactgtcaacattagacagatcaatgagacagaaagttaacaaggatatccaggaattgaactcagctctgcaccaagcggacctaaaagacatctacagaacactccaccccaaatcaacagaatatacattcttctcagcaccacatcgcacttgttccaaaattgaccatatagttggaagtaaagcactcctcagcaaatgtaaaagaacagaaatgataacaaactgtctctcagaccacagtgcaatcaaactagaactcaggattaagaaactcactcaaaaaccacacaactacatggaaactgaacaacctgctcctgaatgactactgggtacataacgaaatgaaggcagaaagaaagatgttccttgaaaccaatcagaacaaagacacaacataccagactctctgggacacatttaaagcagtgtgtagagagaaatttatagcactaaatgcccacaagagaaagcaggaaagatctaaaattgacaccctaacatcacaattaaaagaaatagagaagtaagagcaaacacattcaaaagctagcagaaggcaagaaataactaagatcagagcagaactgaaggagatagagacacaaaaaacccttcaaaaaatcaatgaatccaggagctggttttttgaaaagatcaataaaattgatataccgctaggaagactaataaaaaagaaaagggagaagaataaaatggacgcaataaaaatgataaaggggatatcaccaccgaccccacagaaatacaaactaccatcagagaatactataaacacctctatgcaaacaaaccagaaaatctagaagaaatggataaattcctggacacatacaccctcccaagactaaaccaggaaaaagttgaatccctaaatagaccaataacaggctctgaaattgaggcaataattaatagcctaccaacgaaaaaaagtccaggaccagacggattcacagccaaattctaccagaggtacaaggaggacctggtaccattccttctgaaactattccaatcaatagaaaaagagggaatcctccctaactcattttatgaggccagcatcatcctgataccaaagcctggcagaggcacaataaaaaaagagaattttagaccaatatccctgatgaatattgatgcaacaattctcaataaaatactggcaaaccgaatccagcagcacctcaaaaagcttatccaccatcatcaagtgggcttcatcccagggatgcaagactggttcaacatacacaaatcaataaacgtaatccatcatataaacagaaccaaagacaaaaaccacatgattatcccaatagatgtagaaaaggccttcgacaaaattcaacagcccttcatgctaaaaactctcaataaattaggtattgattggacatatctcaaaataataagagctatttatgacaagcccacagccaatatcatactgaatgggcaaaaactggaagcattccctttgaaaaccagcacaagacagggatgccctctctcaccactcctgttcaacatagtgttggaagttctggccagggcaatcaggcaggagaaaggaataaaggatattcaattaggaaaagaggaagtcaaattgtccctgtttcgggatgacatgattgtatatttagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcagaattgcttcaaagagaataaaatacctaagaatccaacttacaagggatgtaaaggacctcttgaaggagaactacaaaccactgctcaacgaattaaaagaggacacaaacaaatggaagaacattccatgctcatgggtaggaagaatcaatatagtgaaaatggtcatagtgcccaaggtaatttatagatccaatgccatccgcatcaagctaccaatgactttcttcacagaattggaaacaactactttaaagttcatatggaaccaaaaataacctgcattgccaagacaatcctaagccaaaagaacaaagctggaggcatcacgctacctgacttcaaactatactacaaggctacagtaaccaaaacagcatggtactggtaccaaaacagagatatagaccaatggaacagaagagagccctcagaaataataccacacacctacaaccatctgatctttgacaaacctgacaaaaacaagaaatggggaaaggattccctatttaataaatggtgctgggaaaactggctagcaataagtagaaagctgaaactggatcccttccttacactttagacaaaaattaattcaagatggattaaagacttaaatgttagacctaaaaccataaaaaccctagaagaaaacctaggcaatatcattcaggacataggcatgggcaaggacttcatgtctaaaacaccaaaagcaatggcaacaaaagccaaaattgacaaatgggatctaattaaactaaagagcttctgcacagcaaaaggaactaccatcagagtgaacaggcaacctacaggatgggagaaaatttttgcaatctactcatctgagaaagggctaatatccagaatctacaaagaactcaaacaaatttacacgaaaaaaacaaacaaccccatcaaaaagtggtcgaaggatatggacagatacttctcaaaagaagacatttatgcagccaagagacacatgaaaaaatgctcatcatcactggccatcagagaaatgcaaatcaaaaccacaatgagataccatctcacaccttttagaatggtgatcattaaaaagtcaggaaacaacaggtgctggacaggatgtggagaaatgggaacacttttagcctgttggtgggactgtaaactagttcaaccattgtggaagacagtgtggcaattcctcaaggacctagaactagaaatattacttgacccagccatcccattactgggtatatacccaaaggattataaatcatgctgctataaagacacatgcactcacatgtttattgtggcactattcacaatagcaaagacttagaaccaaccgaaatgtccatcagtgttagactggattaagaaaatgtggcacatatacaccatggaatactatgcagccataaaaaatgatgagttcatgtcctttgtaggcacatggatgaagctggaagccatcattctcagcaaactatcgcaaggacaaaaaaccaaacaccgcatgttctcactcataggtgggaattgaacaatcagaacacttggacacaggaaggggaacagcatacactggggactgttgtggggtggggggagtggggagggatagcattaggagatatacctaatgtaaatgaccagttaatgggtgcagcacaccaacatggcacatgtatacatacgtaacaaacctgcacgttgtgcacatgtaccctagaacttaaagtataataaaaaaacacaaaaaatttaaaaaaaaagaaatgaggactgcaataatcaagaggatcttcttgctattttattatgaatacacttgtcagcaaaaatgcctttgagtttaatccaagttgtgtgtatctttctttctttttctttctttttttttcttttttttgctaaatagtatacaattgttcagatgcagcacagcttgtttagccaatacccatggaaggatatttgggttgtttgcagattttgggcaaatatgaatagaacttttataaaaattcaggtgtaggcttttttgtgaacaaacgttgttatttctcccaggattggcattgctgagtcatgtaagtgtatgtttttgggaaattaccaaatcatcttctgcaatggctatgacattttacattcccacagtaatgtatgagtttcaagttgttctttatccttactagcacttagtaatgtcaattttttaattttaatcattttccaatgtgtgtagtgttatctcattttgatttcaattgacatttttctgatggttaatgatgtaaaacaatttttatgtgcttatttgctattatatgctcactttggtgaagtacttattgaggtattttgccccttatcaaaactgggttagaccgggcatggtggctcacgcctgtaatcccagcactttgggatgctgaggcgggtggatcatgaggtcaggaattcgagaccagcctgaccaatatggtgaaaccccgtctctactaaaaaatacaaaaagtagtcaggcatggtgtcacgcacctatactcaggaggctgaggcaggagaatcgcttgaacccgggaggcggaggttgcagtgagccgagactgtgccactccagcctgggtgacagagcaagactctgtctaaaaaaaaaaaaaaaaaaaaaaaaaaaaaagagtgagactgtgtctcaaaaacaacaaacagcaacaaaaaaactgtgtcatgtgttttttaattgttaaattttgagagctcattatgtattctagacacaaatcctttgttggatatacgatttgcaaatatttacttcttgtccgttgctggctttttgactttttattgtctttctaagagtgaaagtttttaattttgagaaattctaatttatttgcttcctctatgaatcctacttttgttgtcatgttcaagacctctttgcctagtccaggtcatgagattttctgcaatgctttctttaaaaatgttgttctttttcatttaacatttaggtctatgatacattttttacacctggatatctaattgttccaatatcatttattgaaaagaccaacatttgtcaattgaattactttaggtcttggtaaaactctacaggccatacttatgtgggtgtacttctgggctctctactcagtttcattgatctgtgtccatgccttgactgacaccacaaggtcttgattactacaggcttatcttaaaatcaggtggtataattctgctaaacttccaaatttattatgctttttataactttttgacaaataaaaatgcctatatagttactttttacatgtggtgaatacacttaagatctactctcttagcaaatttcaagtatatataatacattattattaactatagtaaccatgttgtatatcagatctccagaacttactcatcttatgactgaaattttgtacacattgaccaggattcctcgatttccaccaacttccagcccttgacaaccacctttctactctctctttctatgaggttgatttatttagattccccatgtaaatgagatcatgcagtatttgttcttttgtgcctgatttattttacttagtataatgtcctccagtttcatccatgttgctgcacatgacaggatttcatgttttttatgtctgaataataacagtttctttattcatccatccactgatggacacataggttgtttccatacctttgctactgtgaataatgctgcaaggaacatgggagtgcagatgtctctctgagatcccaattttaatttctttggatatttacccagagctgggattggtggatcatgggcgttattttttgttttctgaaaaacttccatactgttttccataatgtcagtgccagttgacactcccagcaaccagtatacaagggtgttcttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgtacaagggtgttctttcgtccccatccttaccaatgcttatcatttgactttttgataatagccattctaagaggtaagatgatatctcattgtagttttgattttcatttccctgatgattagtgatgttgatcacttttttatatacctcttggccttcttcagagaaatgtccattcagatattttgcctattctgttttctttttactgttgaattatatgagttccttgtatattttggatattagctctctatcagacatgtggtttgcaaatatttcctccaattccataggttccctttccatctcattgattgtttcctttgctgtgcagaaactttttcagtttgattgaactcccatgtgtttatttttgcttttgttgcctgagcttttggagtcacagtcataaagtcattgccaggaacaatattaaggagcttttgcatccccaggataaattccacttgatcatggtgcataattctgttaatatgctgttgaattcagtttgctagtattttgctggggacttttgcatctgtgtttaacagcatattgtgattgttttaggtattctagttccttttcccttccatgaacttttggaatcagcctatttatatttacaaaaatcctgctgcaattttgatggatatctctttgaatatatagatcaatagagtgagaattgacatcttcactaggttgggtctaccagtccactaacatgatatgtgtctctatcaattagttaattatttaggtcgtatttgatttatttaatcagcattttgttattttcagcatatagatcctacacatgattttttagatttatacatacatattatgtgtttggagctattaaaatgatattttaaacttttgattccccattttttacttgtagttgtatgtaataacacttcatttttgtaggttgaccatgtaaccttgctgaagttcttgtagtttccttagggatttccccggcttcttcccaggctgctgggtatgaaaaggcacatgggtgccaagccagcaaaatgagacccatgccttctcaaggctgtactcccactgccataggttattccagatgccaagtgcctcacccactgaaacagccatgagctggccagccagggccccccactcggcctgagaccttagtccccagaaggtagagattagaatccttatatgttctttgcatcagagaggagactaaggacagttgtgcccagtgatgtcaacgtgctggactctgactggtgcccaagaaagttggtaaaggtggggagaggcaggcacagccctggcccttgactaaggcaaggtccctggaagattccactcccatccatcctggacctactgcagccatagccttcactctggtcatcctccaggtgaaagtgttggaagaaaaaaagtgaaaagagataggaggagggaagagaagacacaatctctaggctatctaccaagactatagaaatagaccagctgtatagaaacattggggaaagatagaaagaaggagcaatcactttgtctataggagagaactcctggagttatttgctgctatgattttgtttgaaatacaggaatttgatttgttagtgttctggagatactgtgaaaggaaaagtgaggatctcagaaaagcagagagtcagcaggaaagtcagaactggacgaccagcccagacctggttccctgaagggccaccctccccgacaagctgtgcaaaatgctactgttgggacaatatcttccctagacccctccctagggccccaattgcctccctgggactatcaacatggtggctagacacgactcaggttctcatggatgaatttatccactccccctactcacatggcttgctctagaaggccccttctcttcttcattccagcagctagacatgagtcacctaaataatcagaaacagaggctgcagatacaagatagactaataagggggaaaaacagtagtttttggtacaagttccagacagaattatttaaatacatactgccaatctcaaatataaagatacttagtggtactgaggagaggaggaaaggagaagattaagaaaccacagctaggacctcagaccttcacggaatggcaattgcccaacccacttccacctccactcctgtgggacaacctttccctccccctctgccatcagatgtgcactcttcacagcctggcatgcccatacacaagccccaggggctgtgtccagtactttgaggaatgatgttggactgaagggaaagtatgaccctgattacagtcgactatagagaaccagctttaaatcactctttgggaaaatagtagcgctgttttttttttttaaaaaaaaaggaaggaaaagggaaggaagggcgagaggaagtgagggagagagaaaaggaagattttttttaaaaaaaagaacgctgaagcaaatatgtgagaaaatagggtctgctttggagaggagggaaaagaaaggaagggaaaggagaaggaaataagaatgtggatgacaagttgtacagtggtaagagtctgggacaggggtgaggagattcacattccagtccctgctctcctgctaacttactaagtagcatgtgctatctcttccctgagtctcagtttccccatctgtgcaatggggggaagtggggagttaggccaccaccaatgtccctgtatgctctgctatcttggggaaaggcagactcactcacagaatgaggctgtcagtgagggtgaattttatttgattaaattagtaatggattcagtaaatataaacgtcagctctgttgacaaaaggtttctaaactaatactctcaatcacccatcagttagcacaaatggcatcttatccttcaacttgcttttaaaaaaacagctttattgagatacaattcaaataccataaaatcacccatttatacatacaattcattgtttttactgtgtccacacgattgtgcaaccatcaccacaatcaattttagaatatttctatcttcccaataagaagccctgtacccattagtattccttcttcatttccttccagcctcacatccccagccccaggcaatcactagtccacttcctgtctctgtaagtttgcctattctgagcctttcatataaatagtatcatataatatgtagtcttctgttaatagctttttttacatagcataatgttttcaagcttcatctatgttgcagcatgtataacttcattctttttagggccaaataatattccattgtatgaatatgccacattttgtttatctactcttccactgatggacatgtaggttgtttctacctttgggatattgtgaatagtgctgctataaacatttttgtacaggtttttgtgtggacatacgttttcatttttcttgggtgtataccaagaagtggaattgctgggtcaaatgatgactccatgtttacgtttttgaacaactgctaaacctttccaaagtgcttgcaccatgttacaatcctagcaatgtatgatggtttcaatttctccatatcctcaccaatgcttgttgttatctgtcttttagattccagccatcctagtggatgtgaagtggtatctcactgtggttttgatttgtatttccataatgcctaataagatctggcttcttttattatgcttattggtcattcatatatgttctttggagaaatgtctattgaaatcttctgcccattttaaaattaggatatctttctttttatttttgagttataagagttatttatatactcttgataccagtgtatcataaaatatatgacttaaaagtattataatttttcagggcgctggttcttcctctatccagtacaaaggccatgacaagtgaattcctttgtcatctcatccatctgatactgtagcaagttcccaagcagatgatcttctgttatacctgctattaatctcccattagacttccctccttgggaaggctgtaggcttcatctcctgtactttgtacttcatgtacccatcacaatagaagcacacttctaagattttccagaaacccaaggattaaagctgactttgatactctctcaccttccaggattcccactatcatttcatacatggctccagtaaattccatatttcaatgccaagcagttaggtattttaaaagacttgagttatttactcagcactttagttgttttcataacgggggttgttcagaatatctttttaaatactttgtcaaaaatggaggcctgtatacactttaaaaatgttttatgttgaaataattatagattcaaggaagctacaatggtagtagagaagttctaagtaaccatccaatttcagccaaggattactacctcaaaatcaggaaactgatacaatatatttgttgccaatttatcagaagtgtagatttgcaactaccaccccagtcaaggtacagatcatgatacaattaagatacagaactataccatctacacaaacttccctgtgctaccctttataatcacactcacgctttcccccccgcacaatccccaattcctggaaaccaatagtctgttgtccatatttataactgttatatcaggaatgttacgtacatggagccacacagtatgaaacggaattttaatactggattttttcaatgagcataatgcccttgaggtccatataagttgttgttgcacctttcagtagttttctcatttttattgtggagtagttatgtatcacaggttgtttaaccattcatttattgaaggatattttagttgtttcaattttttgactactacaaataaaggtgttatcaacattcatgtttattttcaacctacttatatcattatatttgagcgagtttcttacagacaccatataattgggtaattttttgaatccactattctattctctgtatttcaattggtatgtttagatcgttttctgcacttgaaagatcttgtaccactttttctagcctctgtgttttctacaaataaatcctctgtcatttgaattgttatccccttataaaaggtgtcattttaatacatttgcagccttagtctctttctcctctccttctgggacttcgatggtagaaataacagatcttttggcacaatcctattggtccctgcagctttgtttatgttttccttctatttttaactctgttgttcagactggatcatttttattactctgtcttcagttcactgatttcccttctgtcctctccattctgctgttgaatacatcagttaaggttttaatttcagttattgtatttttcagttctaaagtttccatttgttcttttaatatctcctgtttcttgctgagactttctgttttcctgtgttttaagtgtgtttgtaattactcgttgaaacatttttatgatgatttatttctaatacttttcggaaaataagtccaacatctgtgtccttttggtgttagcctgtcttgattgtctattctcatttaagttgagattttcctgattcttggcatgatgaggttttattttattttaattgcatcctgggcattttagtattgtgccataagactggatcttgttcaaaccttctattttaactaacttcctctgacactgctctagcaggggaaggaggccactgcttcatcactgccagatgggttcctagcttggcctccactgacacccagggaggttgtctttgttactgttgggaaatggtggcaattccaactccctactagacttcccctgaatatctccttcctggaggggcaggactgcctcattactgctccccatgtggagcactgacatcatggtggttgggcgtggttgcagtatctatgccatattgaaatcctgagtctctgctaggcctccttaccaactggtaaggaatcaaactcccaggcccctactgagtcttctctgttaccatctctggtggggtgcagtcgagtggggtttcaaatactttggtatagcctgataaggttagatatctgggctcactacttggtctttgctgtctgtttggggtggagccacatttttttctgtgttgtctggctggagtagagcagttaatgtctaaacattttctgccttaatgggttacccctgtcctggtcctttggctggagagagcaagtttttgttggggcttttcttgtctgtgcccattggcatttctgggtttgttgcttctttgtctccaagtctgggatatatgaggcaaaaggaaacccaggcaatgccccaccatgccactcctttggtcccaaggtcactagagagttttctttcttctttccactattcagactcttcttgtgcttgtagtatagccaaggtccaggcagtttagttatgtctaccatgttaaacagagaaaagtacctctactccatcttcctgaagacagttgaatccatacagagtatttttaaatagtaataagcccatttaaaaagtcttgatttttaaattaacaccatatcccaggattttaaaataatcccagtcattaaatactctcccttcccaagtcttttatttttattcttttcaaaagttgttttgttcttgtagaaaatataatttttgaaaaacagctcttgtaaacaataggcttctctacctagaaaatcctaaagcctccacaaaaaggcttctggaactgacaaacaacttcagcaaactttcaggatacaaaatcaatatacaaaaatcagtagcatttctatacatcattaacgttcaagctgagagccaaatcaagaatgcaaccacatttacaatagccacagaaaggtggaatagctaggaatatatctaaccaaggaagtgaaagatctctacaaggagaactacaaaaccctgctaaaagaaatcacagatgacacaaataaatggaaaaatatttcatgctcatagattggaagaatcaatattgttaaaatgactatattgcctgaaacaatctacagattcaatgctattcttatcaaactaccaatgttattttttcacagaattggaaaaaactattctaaaattcacatagaagcaaaaaatagcctgaattgccaaagtcatcataagcaaaaggaacaaagatggaggcatcacattacctgacttcaaactatagtataaagctacagtaactgaaacagcatggtactggtagaaaaacagacacatagaccaatggaacataatagagaacccagaaataaagccatacacctactgccatctaatccttgacaaagtcaacaaaaataagcaatgaggaaagtactccctatttaataaatggtgctgggatagctggctaaccatatgcaaaagaatgaaactggacccctttcaccaccacatgctgaaattaactcaagataaagatttaaatgtaagacctcaaactgtaaagatccatattagtctgttctcgtgttgctataaagatctacctgagactgagtaattgaaaaggaaaagagcttcaactgactcacagtttggcaggctgtacaggaagcatggctagggaggcctcaggaaacttacaatcatggcagaaggcaaagaggaaggaggcacgtcttacatggctgaagcaggaggaagagaaagagaggggggaagtgctacacacttttataaacaatcagatcttgtgagatctcactcattattacgagcacatcaagggagaaatccgcccccataatacaattccctcctaccaggcccctctcccaacaccgaggattacattcgacatgagatttgggtgggaatacagacccaaatcatatcagaatcctagaagaaaatatcagaaaacactattctggacatgggtcctgggaaataatttatgacaaagtcctcaaaagcaattgcagcaaaaataaaaattgataagtcagatctaattaaactaaaaaaattctgcacagcaaggtaagtatcaagacagaatggggaaaaatttgcaaaagtatgcatctgacaaaggtctaatatccagaatctataaggaacttaaacagttcaacaaggaaaaataacccacaaccccatttaaaaactgagcaaaagacacaaagagacacttctcaaaagattgcatacaagcagccaaccatcgtgaaaaaatgttcagcatcactaatcataagagaaatgcaaatcaaaaccacaatgagataccatctcaccccagtaagaatggctattcttgaaaagtcaaaaacaacagatgttggcgaggctgcagaaaaaagggaatgcttatacactattggtgggaatgtaaattagttcagccactgtggaaggtactttagcggtttctcaaataactcaaaacaggactaccatttgttccagcaatcccattacttggcatatatccaaaagaaaaccaattattgtaccaaaaaggcacaggcactagcatgttcgttgcagcactattcacaatagcaaagacatggaatcaccctagctgcccatcaattgtggactggataaagaaaacatacatatacaccatggaatactatgcattcataagaaagaacaaaatcatgtgatgcaatttgcagcaacctggtcgcaggtggaggccattgtcctaagtgaattaacacaggaaccaaaaaccaaatacacactggggattactggactggggagggaggggagcaagggttgaaaaactgttgggttctgtgctcagcacctggatgacgggatcatttgtaccccaaacctcagcatcaggcaatataaccagttatcaaacctgcacatgcacgcccagaatctaaaataaaagttgaagaataagaaaaaaagctttattaaaagatatttgacataaaaaaacctgcattatgtgtaaatttcataagctttgacacatgtatacctctgaaaaaccatcatcacaataaagagagtgaacagatgcatcaccctcaaaagttttcttctacccttcataattcctcctgtaggagccccctccctgaacttccattcccaagaaaccatggatctgccttctgttacaatagattcttttacatttggggaagttttatataattacctagaagtggtatacttgcatgacatgataggtgcatgtttaacattttaagaaactgccaaattctcaccaatacttggtattgtcagtcttttccatattagctaatctaataggtggatggtagtctctcattgtgagttttagcttttttcacttagcatacactacgatctgaatgtatcctcacaaaattcatgtgttgaaacttaattgacaatgtgataatattaagaggtgggaccttttagacggtgattaagtcatgagggtggatcccacataaatggaattagttcaggaggttcgagggagctgttagcccctttcaccatgtgaggacactgcaagaagtgctgtttataaagcagagagcccccaccagacactgtgctggcaccttgattttggacttgccagcctccagaactatgagaaataaatttctaatatttataaattacccactttaaggtattttgttacagcagcctgaatgaaaacaacataattcccttgagctgttgcatatatcaacagtttcttccttttcattgctaagtagtatcctatgtacagatctaccatagtttgtttagacattaccccattgaaggtcatttgggctgttttcagcatttgggtattataaataaagctactgtggacattcatgtacagctttcagtgtgatcatacattttcatttttccaggataaatgcccaagtatgaaatctgggttgtgtgttagttgtatgttttatattttaaattaatagacattataaaacagttctaatttataggaaattggacagtactgatagttcccagtagcctcatcctcttatacaattttccttattatgagctttttgcattagtgtggtatatttgttacaattaatgaaccaatgttgataaattattattaactaaagtctattgtttacattaaggcttactttgtgttgtatattttcatggtttttaaaaaatgtccaatgtcatttacccaccattccagtaccatatggaatagtttcattgtcctaatgaatttcttgtgcttcacctatttatgctcactctttctccctgaatccctagcaagcactgatctttttatatcaataattttactttctctagcatgtcacatagttggaatcatatggtgcgtggccttttcaaactggcttctttcacttagcaatatgcatttaaaatacctctgtgtttttttcatggcttcatagctcatttttattgctgaatggtatttttattctgaggtttgaatgtaccagagtttgtttatccattcacctattgaggggcatcttggttgcttccagctttgggaaattatggataaagctgccataacatttgtatggagttttgtgtggagataagttttctactaaataagataaaatatcaaaatctatgattgttgcatcatatggtaaggctatgtttagctttgtaagaaactgctgaagtgtcctccaaacaagtgtactattttgcattactaccagcaattaatgggaatttctgttgctcagcatcctaaccagcaattggtattgtcagtggtttgtattttaggcatcctaatatgatgtggtgatatctcattgttgtttaaatatgtaattccctaattataaatgatgcttatcttttcttatgcttatttgccatctgtatgttttctttgataagtaccttttcatatcttttgcccatttttaatttttttttgttttcttattgttgaattatgagtactttgtatattttggatacaagtcctgtatcagacatgtgttttgcaaatattttctcccagtctgtgcttgccttttcattttcttaacggtgcctttcagtgcgttaatgaagaccttcaaccatcaaactgggatttgcagcttctggtaggaaacacttcaggctgataatcagcctctgtatgagaatggggtcattcaaaatgagccccagggtgattgctggggggatcatgtaggatgaagggtgctttcgtgttaatctcatccacccatgatcaatgcccacccggatcaacacctgccccacctctgcttcacatacttcctcttagctgccctcactcttgacagggccctcatcagaactcaggaaccctgagattccaaaagaggttgacttgtgttttcgtgagagagttcactgaaggtttgggtcatctccagattcactgtgcccaggaccaactcagctgttgaggagtttttcttcctcagctttggctttagtgtctctggtgcagttagcctttcttatagccagaatggggtatacagcctgtgatacttaattttaggtgtcaagttgactgggctaatgtccagatagctgataaagtattatttctgagtgtgtctatgagggtgtttctgggagtgactggcatttgaatcaatggcctgaataaggaagatctgccctcactcaatgtgggtgacaccattcaattggctgagacccagattgaacaagaaggtagaagaaaggcaaatttgcactatctgtcttctggagctgtgacatccatcttcttctgcttttggacatcaattccaggctctctggcctttggactttaggactcgcaccatcatctttccgggttcttgggacttcagcctgggactgagagttacacctattggcttctgtggttctgaggccttcactggacttagactgagccacacttctggcttctttggctctccagtttgcagatggtattttgtgggacttctcagcctccataattgagtgagccaattttcctaataatctcttctcatccctctcatacctatcataggtatatatgtatgtatatgtatgtatatgtatatgtatatgtatatgtatatgtatatgtatatgtatatgtatatgtatatatatctatcctattgcttgcaaacctcagaggtgaaggtagaaagcttacacaagaaaagtctgctcctaaaactgtagacagttggggaccaggtttcagctcctgactcccatgacctctgggattttggtagtgcagcctgtcagaaatagcaaaggggctgtttttcctttccctggggggaaaggatgaggagaatgactatctgcctggagcttctcctgaatactacctacagtagacactcttactgatgaatggcagtattttagaacttttgcatatgttactggcttaagatgagaagactaccacaaagggagggcatgagtacctttaagcggggaaatgagaaagtaacatcctttcaaagatcaacggaagacacctatggttgccactagtgcaattccagaatatatagatcacccctcttgggtacacagcaaactgaatgtcctggttccttatagtcgggttaggctatggtgttggttctacctaatgagtcatgagtttgagtgaggtatgtcctttctggctgcagtatttagttactagtgtgagccccactactttcccttccccttactacaaagattgtagaagcacacgatgaaatctctgtcagcttgttcctgagttgccaccatgagcagaagctcccctgatgacctgcattagatgtgcaatgtgagaaggaaataaacatttttggggggtcaagtcactgggattttgggattgtcacaatagcagcacctaacctttcctgactcattatctaatactaaattgggtatttccaagtagttagccattgtctggtggtgtgatggggcagccacttttatttattggagaggaaggtggaggtttcactttcttcacgaaaggatttacatacttctccatggagagtgtatcagggtgggatttctcgaggcctggcccataccaacctagagtaacaagagggtttttgattaggtgaaaaatgttatgctccgagaggcagaccaacagtagcaatagaaaggtgtgtttgtgtggtggccatggagttgtgtgtctttcagctctccagtaagagaatctgctattggaggcattgttacttatcagctacaactgtacttgtgtggaggccatgcttcccctggggctgctcccatccagtggctgagaggagcagggatgacattgctggcctgttcccagcctgtgcaggaccagagagcacaagtaactgcatgagcagatggctttgacccctacactgcttatcacagttgtaccagcgccccttccccactttgtacctgtgaccacatgggggagccctttatgaccagctgtaggagggaaagggccctagctggtttataaatgagctggttcagtctgtgtgtacaagctgaaaatggacggcactgcatgtcaggcacacctgggggtggtcttgaaagagagtggcaagggaaaatcttccccttaatgggtagagctttgagcacctagcctggggtcagaatgggctggctagctggtcaggggccagggagagacaggactagaagaggctcccaaatgaacaaagtcttgtccaagggcacacagagtgcttctgagagaagcgggtggggaggagttggtgcgtggagagctggggtccataatctccaataaatttttaacctcctttcccaacccagagtgatactggagggagacttcctaagaagctggcgtatttctactcccttttgtttctctttgagaacactaccttggaagatattacttcttttaagttctttcctccaacccttttgttttgttttgagacagtcttgctctgtttcccaggctggagtgcagtggcacgattatggcttactgcagccttgacttgcgggctcaagtcggggctctccccctataaaattgaacgaaacttctaccttgtattttggcaccacagtggcctgttctgttttaaaagttttgttttagaagattaagaatggcttctgcaaaaatcaaaactaatttaaactgtgctgttgctaattcccctcggcttgaaaaccatggcttccactgtcctggggtatgaagaggtctatgtgaaaagcggtgggaaggccatgggaagtgagtgatggaagccagaggtttcctgggcccagacagctgtcctgctcaatatcttctaatccaacagagaggaaacacgatgacctggtagagtacttgttattatatttatttatttttcttttagctatttacaaaattttatttcagtatatttttcagaagcataattttacgtttcttcatattttactttgttaaagtccggaccagtcaaggtccttttcatgcaaagatgtacatttaatgaggacaaagaagccacccagtcacctggtgaagctctgctgctttgtgcccctttttgggtcaggtcgtccaggacatccaggtcttggtctttctcctcttttcttgattttcactgcctgggcccagcatcacttccaaagacctccgtttgtttgattttactgtatttaatctgcttcacagaatgttaccgacttggctgacctctgaagaatcccccggtactgccctatgtcaggcaccacagccagctgtgctaaattcgggcacctttagctctgctgactactgaccctgggcatgcagtccggccggcgagatagtgagtgcaaagtctcacacaaattgagtcaatagaagtgaccctgaacaactgggctatttcataatttaagtttatcaaagagagactttaacatcctctccctccctcccctgaaaacccaacactgataatatagattttatattgatcacaggacactacacaacaaacacaaagacactacacttctagtaggacgagtcacgatttcctttgatgttgggctatggaatagctagaaagttactgctcatcaccacagcagggtaccatgcgagtggatagcttaataaatgcattcattagttaatggctttaagggttagctattatatatatggaatgaggaaacctcattaggaatggccacagtctcagcaaaactcagctctaaatatgcaaagactttgaagtcctgctattaacaagatgacatgaattgtaagaatacatttgacaggctctagtaagacccagcagatcgtccatgacctgtgcaaaggcaccccacagtggcagatggaactggcaagaacttggtaggaaacgtgtcacacatccccacaataaaatgatacttcagaaagacagacaggggtgtccttcccatgatagtggcaaagaagggatcctgggtcggggaagtcgatgggaaggaaagaaatggaaggtgggtagaagagtaaaataggggttgttgcatcccagatgctgcccaagctccaaactaccaagcattctgcacttccagagttacctggtgtgaggtgaggagagggatgggatggaggcagcttgctggacagggggtgactgcaggctggggaggggctgggaaggggttggggacagctgaggactcaaatgacacagaggacagaccacatacaagactcaacaaggggagatctggcaacgtgcaggctaaaatgaccaaatccatagcaaactcagaaggttcacgttcccgaaagggtgtcactgccaaatctccacctcattttgacacttaacctacagagtatgagtcgcagtagagttcaactgctctcattgcagcacgtcagggcaagatatcctttttaaggtatagtattatatctagctatatggatctatagagatatttacaactggcctcgctgcccttcctctgtgctgtgaagccttcatgtgcattgcttccagacaaatcttaaaaccctccttttcttcacactgctccaatctccctttatgactttatcccaaatgaactgcttgccaccacagggttgaaagcacctccagggtgctggagacccaaatccacgtcaaccaaccaatgcttaggctccaggaagccagcctttcaatagccacattgggagcttcagacatggagtcactgctctcccctccacctgaatctctatatggggtatccaaaaataaagaggcaattttagctcttccagtggtaactttcttgttttcaactgttgtacaagatttgtgtgtgtgtatgtgtatgtgactgtacaagtgtctattctcaatgcctctttcagcctcactccccagcctgttaccccgaaacatgttcctctaggacaaagtgaaatgctctgtacttgcagcttcttccatggattaaccacttcctacctcaaggcactagctcaccacttcttaggactacattcacttccccagtcttctatctaggagacagcacagatggatggagggacagggcaaacagtggaagggaactgggagatgctgctccctggaacaggaagttggaaagaaacagtcagttaagcagcccggccaaatagggcccctccaccatatgggagcaggccaagggaattatagtggttctagaagggtcaccaacagggaatacatatgctttcaggggtatttcctttcacacccattcaaatcagataaacatagatatgcagacatgcccttatatacatgcactcagcatagacccatgtgtacacaagcatacacatacataagccacactttcacagggatgtgcacacacacgcatgcatccacatgctgtagatacaattctgtacacaccaatgtagatttacaccactagacacggcactatgcagcttctcaaatggttgtatatgtacatacacccaccctgctgcatatgcatacacccaggtatatacagaaacacaaacacagaagcacagttaaagggtgagtgggtagaggggtaagggactgagggagagactgcatagggaggaagaggtggcatatgttgagtgctcggcaaagttcactccctcacaacctccatcagtgaggtggagctgcttggcaagttggaatgctggccaatcctacttccgttaggggccctgctcagtgggcagagagtgtgttctccatctgctcacgtcacgctcattggctggtcaccagcctattcctgcagagatgccccaggtgctagaggatgtggtgggggccctctggagcaccctctttagggagggaagaaaaggaaatgcctcagttgggacagtcaggaggaaaaagacaagaaagagcaagtggggtggatctaccactcactggctgcatgtcctcaagcatgcggcataagctccattcgttttccttggaacactggggacaatgtgctttgccttccctggcttacagggctcctgtgaggctccagtgatgtaatgggtcagggagcttgttgacacttactatgcactagacaaatagaaaggattagtatatagacttacgatagatattcatctgctagtctagatcagatggtaaaatagcaagtgtgaattatcctaaccttagtgcttattcaccaagtgctgtaactggtgatcaactcagcaactgacggaaagctaactcctgacttagacagatgtattgagtctctattgccaagcgttctgaagcagaaatataggcaagttccaatccctccgaagaggccagctcaactgtgtaatttccaacctgacatcaccccccaccctctgccaaccccacaagctgagtatgtgctctctcaccctgatgtctcactctgcagccccatccacccacattccccttccacgcttgcatcaaaacaccacagtcaaatgccatacagtgggggaaaggcacttacaaatgctccctaagtttcctataggaagttccctgaacttctaagccatggctagccctttagctatgaaccccagcccaacccagcttgactttcttctataaagccctaagcagagggtgaacaagacccataatccctaggaggaaacaaaaaaagaagaaaacatgtaatgaaaaagaaatgttgacacctcaagggggacagaaaagccccccagaaatgtttgtgggcaaaaggcccagatccttgccccatcccccaacctggctcttctctgtcctctaaacatttccaggggcttttctatgcttattccttgttacaagtctttgaaaaggtgagagtcttctagcaggaaaggaaatccatgtgctgtatacctccaactcctcctcaatcccttcccttccagctagaacatgttctttccaattactccccacctcatgtttataaagagaagtatgaacttattggattgcccaaataaccacaaaataaaaggaacaaaggaaagagggaaaaacaaacccaaaagaaactgaaaggagcacagcacagtgctcccgctgttctggagcactgggggactaatacatatggtatacccagtaaacaatgttgaacaacccaaaggccagagggaagaggaaccgggaccacttgtcgacctttgggacgtagtcaggattaaagagatcgaaggagaacccttcagtgaaggagcacccagggcttggggggcaactatcctcagactctgagctactgtccttctcttggccatgggccatgagctcatcatcattaaggccccaggtactgttagtatcacacttgaattgctccttaatggcaaggcagtcgctcttgtcattgttgtcatcaaggtcccagcctgcttcttgcacacccttctcgccatggtgaagcatgggcttcccactggggccatggccatggcgctcatccgagctcaagctctcattggaatcttcatggtcatgggtaacaccatggccatgggcttcgacacggttgcggatttcggtaggaaaaatactgtcatcagcctggaaaccattaaagcgaacaccatagctgtgccgggcctgctctgaggtggaggggagatcgctcaggctttctccagtggccaggggggcctggcctgagagagaagtgagtgggctgaggctttccgaggtggccagctgggcctgctcggaggtggacgtcaaagaaccgaggctttccgggcttgccaggggggcctgcgctggggtgatggggagagagctgactccgtcttccacgttaatcaggccatcctttgaggagataatggataggctcatcagtttcatatcgcctagatggatatgcactggggggagggaggagggaagggacttccctcatcagcacttgtaatgttactgatctctttgacagatagagccagctcctcttggggtctctggtgttcaaggggtgaggaacaggaccaatcggctgttagcatgcaagggaaggctatggaggctgccaagccagtgtctcgctggaggcagctgctccctcaggagtgctgtgtggtggatggatgcctgctcaggcaggcaggaccgggctttctgcgaaggagggaggtagctgggcattaacatactgcccacagcaaaagcctcagcattgccttgggagtctgaagtgccaaggaaggaggggtaggtaggccagcctctccggtgtctgtcttcctttcagtctccctgcgcccatcttcccttccagcttcattgcctgctctggaagcatgcaaagtggaccaaattcagtccaaaggtctggagaaatttagctctgccacttacttgccttgtgaccttggacaatgatcatctataaaggagtgatgagaaatagtactacttctttgttatatgttgtgtgtgtgtgttttgcgtgtgcgcgcatgtgtgggtgcgcgtatttaaaaagctaagaaatgcaaaagggtcaaaagcgctaagcctgggctcaagaggtgctcagggaaagctgattgtcagtcaaaaagtcaaacctgcacgtttcctaccaccacttgctggtagcggtagcgggcaatgactcttcggggtctcctgtgtcgcctaggctggcgccgaggtcctcgactgtagaaaagatagttgatgtagacatactccagcaaggacaggaacacaaagaacaagcacacgaggatatagatatcaatggccttgatacaggaaatgttggggagcttatcccgcagatgtgagtcgatggtggtcaggatgagcattgaagttaagcctgtaagcaacacagtacagacttagtctcctctgatggctaacgttcttggcaacctgtcaggcccccacccaaacatatttggggtgaggagggcccacagcaaaggccttcggctctctctttattccttttcccccatctttaaactcagcccacgcttcactggttcaatgacttcttattgctcttagcgtcaagtctcaaacctctagccgtggcttcatggcaattgacatcttcagccccaccttggcctatgatggctcctttcccttttgcctttctttagttcttgggaaggttttctgagccctaaactattacacaaatataaagctttagtccagaacgttctcctaaagagggaggctgaggagtctgccccacagatggtgaaggagaaaccagacctggatctgggacacattgacattctgctggatggggccagacaaaccagggagttgatctcttaggtctcttcttggtactgctcaaaaatttttcatggctccccatgcttagacataaagtacaaggtcttcctaagcctgaccaggatgtctttgtgctgctctcctcatctcctcagctcctgtcccagacaccctgtgatttagcccccttttaatggcccctatggtctaaacttatgactcgtctgtttacttatggattcaagaaataatgaattctggtactcggggctcaacgggccaagattccaaccttgattttttttcacatctgtctctaatatcggtctctctattggggattggctgtgcacctgtacaaaggtgcaaatgtctattggaaaaatccttatttccttgcctgtgtagttagtcacacactgttctgggtactttttccttactctcaactttttttctgagccaaatgacccaaattctttcctgggacagagacagaacctaccaattgtcaccctggctgcagaggaatcatagttcatccaaaacgatatccaagaggtaatagtggtgaggacagtaggccagtagacttgcacaaggtagctgttaacttccctctgaacctggaacttcagtatcaggcgtatgtaggaacctggcaaggagacacactggaattagggtggcagggctgaggcgcatttgcagggtggagaggtacaggatggagaaggaggggagagcaatgggaagttcagcttgtaatactccatccagaggcatccagcttgggcagactgcactagcagatcagtgacagtggcatatctcagtaggcgcatgagcatagcaagtctgctctctccactttcctttctcacttgctccatgttaggtgaagttttggaatgggagaggcaagagatgttcccaaggtacaaacagatggagggtgaaaggccagccctgagaggagcatgaatcttttacacctgcagagtgttgtgaacctggctaagtgcttccacggccattcctcattggcggtggatgagtcattggggctttcttaagggggcctggaaccagtaggaagtggaaaaggaggcaccagagaataggagccaaaatcagaggccgctaggagtttatggaggtgcaaggcagacatgagacaggagagaaggaaggggtcagacccacctgtgtagaaatacacctccttgctagtaatcgtccttcccaggaaagtgaactgagggatatgcagctcctcagtcatgtggatggcgttcccattgtcatcccagaataatatgatgtcttcaaccgtgtaaccatctgggaaggagagaaacagaggtagtctcagattcttagaaagaaagaaaagcacaaaaaagacatgctacaagctcctacccactaacttgcacacactttcccaacagtaaggtgacattttcccagaggaccgtttatgctctaaagaccacctagtcccagatgctgtatttatacatctatctgtcaataagttatctatcacctatctatctctccaccatctttctctctttatttctatcatctgtctatcctctatcgtctatttattttgggagagagaatggggggagggagggagcacaggagatacactggcccttttactgtcaattcagcctctgcttccctgatcaccacagccccaagtacggaagagggggccataggagacatacgtacagctctctaccaccaggttgcaggcctgcttgtccatagggaatttatgcagatccagggaacaagctgctgtagtggtgagtctgcaaaggaaaacaaaaaggaaggagaaagtgagtgaagcctaggcaaacaaccattgctgaggaaactgcaggggtggggagggaagagttatcccaaggactgacccatgtgtagagaggagagaggaaatttgtttgtgacaaagtaaccaagagacctggcagcacataaacagagaacacacgtatggcacctcagaaaactgcagggtgtcagatgggaagggccccggaggaaactgaatgcagagacggaaaggggtgcttcctacagaaggagtgaggctagcaagagaaaactgtgtgctacgccaaatcagctgagactccagatgcaatgtggagtgctggtgtcaagtgtgcatgtacagctgggagcctccatccaggcctgcctctggccacatctgtacacaagccagaggtgcaggcctatgtgggtattggggactagcaaaatgtcattgggtgcgaaatggacagaagggataaacatatctgtggtgagccatggcactgttgacagtacacgaagtgggcaggagctttaagttgcaatgtggtgagtgcatccataagaagaatccggccgggcgcggtggctcacacctgtcatcccagcactttgggaggccgaggcaggcggatcaggtcaggagatggagaccatcctggctaacacagtgaagccctgtctctactaaaaatacaaaaaattagctgggtgtggcggcactcacctgtattcccagctactggggaggctgaggcaggagaattgcttgaacccgggaggcggaggttgcagtgagccgacattgtgccacttactgcactccagcctgggcaacagagtgagactccatctcaaaaaaaacaaaaaataaaaataaaaaaaagaagaagaatctgaggggtctcagaggtgctgagaaagtgggcgaagtgtccagtgggagagaagataacacacaagctctctacagcctcccctgggaggctctgctccatcccttattctgcccttcttatctgctaaccccagctgagtccctttcaattgcttccttgaaataatttccattttgtacactggatatggtgtgcgcgtgcacgtgtgagtgcatgtgtgtttttctcccttctatgaatcctccatgcagcattattcagctaattctccctttaagtagaacaagtgtgaccagtgacctgttccctgtgagtcttgttatttcccgatttcagagcctgggtctgtgggaaggtggatggaaaaaggaaggaatggagcaagagctccacggagaaagagaaacccagagattagatctgtaaaaaccgtaagagccaaaccctggtaactacttctcagacacattttctgagctaaactgatctcttacacacgtctttggagacagtttgtaagagatgccgctgtgaggagaaacttggtgactgtctcctatgctataactagactagtgaggaggttcagcttgcaattgctccgtgtgtgtggagagccatagaccagagacccatgccacacacaccctgcccctccgcactcctggaggccctgcatgatgcaaatatgactgaaggcagaaagcaggccccctcgttcactgcatggacttcagcattcatcttctccctccctcactgcacagagagaaaagacaaagataaagaacagaatgcatgcaacactagggtggagggagaggtctttcagttgagggaatcaaggaggacttcctgaccaagggggcatttgagttagggatttcagggtgggcaaggtttcagctcatggaaagggggaaaggactgaccaatccagacagaaggaacagcagaaaccaaggtgtggggacagaacagctaagggtgtctgtgggaaactgtgaaatttccactttggctactgggtagaacgagtgaagggggaagttcaagacgggtttggaaagcagtgggtgcctttgtgtgtcccttagagtgtgtttgtagaatattcagtaggaagaaggaagtctgctgggacatccccagacccctaggggactcaccggatgccgtaccgcaccgttccatctgggtgaagctgaaacacgcgattctccacagtcacatcatgcacgaaagcatccttgctgttcagaaagtagcagtcagggacccacaacttctcatgcatccgatagtccagggtcaagttcagggtggtctcatagtatgctaagcgtgaatctttccaagtctgatgaaaaaacatcgtgatcgtgtagtcctgggaagacaaatgtaaatcccagttgtaagtttggttgtccagagctccatccttggtgtgtgtagggtgtgtgtgtatgtgtgcatgcacttgtgtatgcaagtgtatgaagtatatcataactatatacaagtgcgtgaaacatacggaggtttaaagaaagaataaaatgaatcttgtgtaattagaatccaggttaagaaacagaatattaccaataactttcaaaccccaatgtatgtcttccagaatatatttccctcacacccccagcagtaaccattatccgagtttttatgataattcccttgctttgtgtgagagttttattgtctatgtattgctggaaaacatattgcttagttggacctgtttttaaaattttatctgaatgaaataatactgtatgtattcataatttgcttctttcactcaacattatctttgtgagattcactcaggtggacatgtgtaattataatttgttcacttgcttttctggataatatacgaatataccacgcagattatcatatgaacatgcataccaaaaccatgatgaaataaaaatgatgaagtagaagttccactttatatccctgccgaaagccaagcgccaaaaagctgcagagggttcccagtgctttggcttcaccaacattggtattgtctgacttttgacttttgctaatttggtatgtaatgggttctcattcaggttttattttgcactactaacaaggctaaccgtcttttcatatgtttcatatatttacctgctgtttaattttcttacagaagtgatattcttgttcatattttctgataatttttctatcggtttcaaaatattcttattaattcacaaaatgatgcatattttgaatatgtccttcatgctgcaagcatcttagtccactgtgattgatcctttcacacttgttataatggttttgttttgtaaaacaggagttctgtaaatttggttacacagaatttcaatatagttgaaggtaccagatttattttgtgtggtctgtgttttctgtgtctttttaaagaaatcctactgcaagacataaagccagtgttctacactatcttttaaaagcttaataagcctttcacttttaagtctataatccatctggagccgagtttctggatgtggtgtggtgtaggggttgaattaatgtagtttttattctgaatggctgcagtgtcccaaacctaccttgttcctttatgtgagttctgtcacaggtcagaacaactggacttggattataagcctgctgcttgttccatgtcctctgttcccaaccccatggctggaaataacacacttaccatattcatttctgagatctgttcaatgctcgtgacataaatagatattctcacaggcacaggggcacctagaagacagaaagacacagttacacgaaaggtagaataaaggttaagagcataaacttgggagccaggctgcctgggtttgaaccctctttgaaacttgttagttgtgtgatcctgagtaagtcacctaaccctgctgagtcttaatctcctcatgggtaaaatggggatagtgatagcactgatctcatagttagagcaaggcctcgcccacgatgtgtgcaaaggaaggggtcagggcaaaataaagagaacgttaagggatgaagcactccttctaaacattttcctgataaaacctgaaaagcaacgagccccaaagcaggagccaagattcatggctgtgtgtgcacatgtttgtgtgtgtgagtgaatgtgtgtgtttgtgggagcacatgtgtgtctgtgtgtaagtgattgtgtgagctgtgtatatgagtgtatgtgagcatgttcatgcatgtgagtgaatttgtgtgttcatgttcaggtgaatgtgccagtgtgtgtcatcatgtttgtgtataagtgaatgtgtgagcatgtttgtgtgcttgagtgtgttgtacagaagtaaatctgtgagcatgtgaatgtgtgtaggtgtgttgtgtgggagtgtatgattgtgtttgtgttcaagtgagggtatgaccgtgcatgtttgtgagcttgtctgtgtgtgagagtgaatgtgtgaacatatatacatatgagtttatgtgaggatgcctgtgtgggaatatgtgagtgtggttttgtgggactgaacatatgagcatgtccataagtatgagtgtgttcgtgaggaggtgtgaatgtgtgagtgtgtgcgtgtattacagtatgtgagcctgttcatgtgttagtggatttgtgagtatgtccatgtgtgagtgaacacctgcgcatgttcatgtctgtgaactagctgtgttgatgtaagtgtacatgagcgtgtttgtgtattgtgtgatgtgtccacctgcactggcatactacacatgtatatggaagactgtattagcatgttcgtgtatgtgagaatgctcatgtgtgggtgaatgcaagagtatgtgtgtaagcatgttaatgtccatgtacctatcaatgtagatgtgcatattttcagcaggtgagtgaatctgtgagtatattgtgaacacgttcatgtgtgtgagtgaatatgcgagtgctttcatgtatgtgagcacgcccatgcataagtgaaagtgtggttatgtttatgtgtgtatgtgtgagcatgtgtttgtgtgtgaggatgttaatatgtgtcgtttttgagtgaatttgtgagtgtgtttgtgtatgtgggcctatttgtgtgtgggtgaatgtgagtatattcatatgtgtatgtagatgtgggagcgtgtttgtgggtatgtgtgttaatgtgtgagtgaatttgagcgtggtctcgtatataacgtgtgtagtaaatgtgtgagcatgtttgcacgtgtgagcatgttaaagtgtgtgaataaattcgtgaaggtgtttggatgtgtgagcatgtttgtgtgagtgaatgtgcatgtgtgttaaagtgaataaatttgcatgtgtgtgtgagcatgtttgagtttgagtgaacgcgtgcatatgtgcatgtgtggatgtggacttgtgagtgtgtttggtgtatgtgagcatgctaatgtgtgagactaagtgaatgtgtgatcatgctcagtgggtgtgtctatgtgtgagaatgaaattgtgagcatgttcatgtgagggggtgagtgcacaggagagggtaattgtgtgtgttaatgtgtgagtgtgacagtgtgtgaatgtttgtgttagtgcacttctgcctcctagcttttgttcacacccaggtgttagcactgtccacttgcagtactcaaatgtgttcatggatgtgaaaatatgtagtacactacactgtaaggcactgtgggcaaatccgtttttatcgttcgctcctcatctcaaagctttctacagccagtcccacagcaaagcccttagtctccatgtattacatcacactgctgctagggaaacatgcatgacgcctgcaattcagcctgctggttttactgcaggctgattgcccagaagctgagctgcaaagagagaaatgtgttattccaagcccaaagcttcacaaaggaaagctctattgggaataagcatctgaatggcagccgtgaagtaaatgagcctctgtgttggggtacagcccagactccagcatccaggcctgttgtgaagaagccccagaaaagtgttacgtggtgacaggagttccaagaaacacagttcttgatggccgcctttcgggctccccacatgcctttagagaagggaagctgtgttaggcaggcaacaagctccagaggggccagccagctacacctcagtgttagacttctctagaccattccgcatgattcaggcaactcctttccttatggtggaatgctggcgaccccgaagggctaggccagaaacctgtccaaggactcctagttgaagggaaagtgggagctgaaatgcagttcacattcccctcaccaagccatgagtcctggcacagggatgcagctcagaggaaggggacattcttctaatttatcccctttgtgctagtagttgtcaggatgagaatttagatgaggaatcccatatccctaaacagataatgggggtggggaggggatgagaaacgtcctgataaggagtccaaataccatgtctaggatggtggccccagcccatcactgtcccaccctgccccctcaggaaggcaggcaaagtggtaggggtaatcacctccctttctcctggaacctttcctgcctcaactgtacttcctatctagcagatgaatgaaggaatgaaaatatctccttcattccttcacaatatcgggtgcctaaatcatgccaggtgctaagctaggtgaggccctcaagggcggccttttgccacaatgcagagtcccagttctcttgcctagaaggaattggctttgttaattttctctggatcctcctcctccttttcatcctcctcctcttctcactgtcccccgtatgcaaggaaggaataaggctcctgtttgaactgggccacagttaagtgaggcctctgcatgtggaggatgtgtggggaagtgaggggaagtatgccctgaaactctactccacctctcacacagaggggaatttgacgctgtgtctagtgggggagtcctggagtccccaggcgctgactgccttggcccagctatcccatcaactggtctctcttcccacacgcaccatgcaacagcctcagacctagagcctgtggtgcccccttctgtttaaatgctagaaggtcctgagttgtccttgccctcctaccttcatcggtttggctaaatcaagccagggatccagcttttctcacacgctgcaggtgtgcacgtccacaaagcttagggtaaccctccccagagattgattcttgcccctgctccctcccccggtcctggatgcctgcagagatgtcaacctggccctgaaacagtggggagaaggtgattggtgtactcaaatggttgttggtcagtctctgctgagaaacgtgagaaaggcaagacaaaaaaacgaagtagctactcccacgtcacccattggtgcttggtgcaactgatccaaaagattccaaagtcgctgccatacaaggacgtgctgcctgtactctaacacctggattcccatatggccagacctttatcccttggggatccacccagaagacacgctgctgttttgcaatgaaagagcctgccttctggcctgtctaccctggcttcccagtatgctctcagctttaatcccttgggctgtgccttctgctctcacacttcggagggagcaagggagctaaggggaagcaccagttcagggtcccacctccaaagcttagggcccaggactaccaccttgcttttcaaggtggcgctccccaggccaaactggtctaccgcaagggccgaatcctctcagctgtgttttcttggggtggagccagagtgtatttggaagacctctattcatatgcataaatgcagatcattagctttcattaaccctttggagtgggagcttcctttgagctggaatgtaactaacctcttttttaatggactgtttcttttgtttgcccttgatctaggtttcctaggtgtcccctgggctagagaatgctgcgtttgctacgccgggtcagggtaggttgcctgtcacttaaagctgtgtggtccaggctagtcgccctttttaaatgggaggctaattacaaaaatgggggaggaactgatgtatgattttcctgggggtttgtgtgtcagcttctttgtcgtttctaatctcagcagcagagatctgaggactaggctgaggagtttggattttatttggcagttagataaaaccattaaaagttcctgaggtgatccggctgggtttagaaagaccacactgactgcggtgtcttatataaactgagaatgagggagctgaggtggaagtgcccagggcctcggtgggttaagtacactagacagaaaagaccgtgctctcagtttggaactagctgaatgggacaagtgcccagggtgtgaagaatgtgctcaagtagaagaatatgtgtcctcccaggagctggagcagaaaactctagcctgaggaacacagcgcgccgcatcctgtacacccatttctgtgcttagctctttgccagccacacctttgtaaggggagtgtggaggagggagaaggctctcgtgcatctgaaggcagagaagtgagagatattacagggtgcagaaggcctgggggtgcttccttgctggtctctgcagagtcaggaaggtgggatctggagaggcacaggtgtagagcccgcaggataccactggtcagcttacagggcagggctggcttgctgtgtctcagctctaggacacctaacccaagttctctagtgtctggatatgccttacctccaaaattcggtctcaggcggacatcgtatcttgacagcaccctgtccaaaatcttttgaaccacagcttcatttgcacaatttttgctgaaacagagaagtcataagtaaatgccggttgacttggggcccgcttgccagtggttgccttgctagggccttctcttctccagcacatacgcagacatgtccagtcatacgtgtacacactctctctccctgctcccctccctccccatggtgagtcagccagaagcgcagcggtgacgcagactcctctttcctccccccccccaccttcccagctttaatccagagggtggggctcagagactggatccctgttaccaggcaggacttgtaggggttgacgagaggaggcggtaggagaaggggagacgaagaagagtgggcagatgaaagccctcagaaaaatgcattacttcagccccttcaagagccccatcttgcaatcagcctcgacgctgttttctaggttggtgggggtcctcctgccaggggcacctgattgccccaggaaaagtcatcttttgctctcagtgccctagtaagatgagctcaaagtttcatttccccttacctgggctagggctgggcattttttagtcacttttatgtcaaccttgtttctgcacaactctgttttccagacttggcatatggcataagacacacagagagagccttgctggtgtagctgagatttacgaccctcatccaaccaaaccatttcagattcttggggctcagagctctcatcggaaagacatctattctgggagcaggtatatctcttgctgagcatgtgcttccaccctggaggtgtcttgggtgagcataggtaagtggactcagcccagctctgtggagagctggcttttccagagatctctgacacgctcacccaattcacctagaccttcaacagggctccttccccaacagggcttgcgaatcagaacaggccccggcatcactgtgactcttcaaatctttgacgcattgcccagggaacgtcagcccctgcaaatgtgtgtgtttgtgtgtgtgtgtgtgtgtgtgtgtgtgtgcgcgcacgcgcatgtgtgcatgttcagtggcgcagtatggtatgttgggttaagggcactgcagggctgtctgctggaaccttgccaaacaccccccccccctttatgagtacatgttaatttctggcttgccatttaaacattgttaaaaattattcctaatcatctttaatcaaaaatttcattttgcagcatcccaaaatgtgcacatgaattattcccaaattaaagcaatgcattcccacctgtttccaagcacacattacccatgtgccaacgctcaggatctgtggccaccccaaatacacatttctgtgtgatttacatgtaaaggcttcagatactcgcacacccaaacaaacttaaaatcaaaaagagaaaaaaaccggagtcttcaaatattttcacacgactaagtacaaaagcacacccatcccagaccacacggttcgtgtttattcagacacgatcgcactgtctgggctccgatgggtttgagttaatcatttctatctgccgcattggaaagagtccctcatcccctcaacacatgcatgcacgcgcgcgcgcctcaggaaatggactaaaatgtagactcaaacaggtgtctctcctgtctatgttttgtgaattgcccgtcatcctgtaccctcctccccaatcccacaggtgccaaagctggggaaagctgccgggaaccttaaatccttggggatggatggacagatcctgggacgagggcgacccccgcccccacccctcgggctgcggtttaggcacacgcagggctcagtcaagctccgcagtaacaggtgggcggaagcacagggctccatttcaacaccccactcccaccttaccccttctaggggccaacaggcagggcccgggcgccagggctcagcgagcccgggtccgagtaccccccagcccgagtcgcccccagcccgctccgtccaagaggccagaggtcgtctgcccgtctccattcccgtccccgccgtgcctagcctggcggtgcccgcttaccagttgaagaggttcaggacgacttcgggcacagcagaggagaactcgaagtggaatttcgggatgggactggggtagttgccctccgcgagccaggtcctgatgagcagcaggatcactgcggctcgcagcatgcctcggatgcccatggccggggcgttctgggcgcctgagggcgcgggagacggggccgcgaaaaggaacagaggtggggtgggagagtgggtgactactggggccggggaaggcgggattgctggcccttccccaaagagtcgcctctaaggagagagcagcgagggcaagggaagtagggggtgcgggggtcggcccggataccggagatgagagcccgggaggagcaaccacccagcagctctgctggacgcagctccccccagggcccgcccggcagctgcgaggtgcgctccgtctgcggccgctcctggctgcgactgggcacagatcccagctcgctgctggctccgcccactccgacggcatcgcaggcccagccaatcggacagctgccaggagccgcacaaaaaggcgcgcgctcctgcctccgcccgtagcctgcgcgccgcccggcccccgccccttcaggcttctgcagtcatcccccggccatctccagacacaggcagggcggggccgggctgggggagggggaggagggctggctccttgggggctgggccaggaatccgcctcaaggggcactgggtcctgtctcttctctgcaaaatgcgaaatgtgtgtttttcttggaagaaagggcctgtgcccgagagttgtatttgatggtgaagggagtgtggtaatttgaccgccatggctgaatctgcattctgaaagacttggacaattttgggcgtcaggaggtacccaacggctggtgactccgtacccttgagcctccagtaaccccgcgtgccttgtctctggataaggtcaaggaggatcctaatgggttttgttacagggctctggccacagcaggactgctcctccctcaggatggacattgggctacaggagcccaagagttgcttaagacttaaatttcctagagtgctcttcaccccaactttgggtactcaggaaaaagactcaaggaactggaagggctcaccaactggggtctctctgagatgtggttgtgtctcatcagccaggggatgcagaatgaaggttcatggctgacaccatagaaggggaaaaaaaggccaaggtcagtgtttggggtgttcaagggagttaggcactggagaccagggtatgccaatgttcctgggttctgaccccatcatatggaaaagcctgacatcttgactagagggctcttattctttccactacctcagactctgcccctatgggacagaaaaatcgtggaggataagaaatgcctccacccaatttcctatgtccttcctatcccatgacaaagcaagttcagaaagcttagaaagtggcctcaccagagcccatagggcaaatgggtaatcaacaaacagagctgccatgttcaccggcatgccacctcccacatcacaccattgagaagagttgaaatcaaaacggatttcaggtttacttttggttacctagaacattcactgagaaacacaacatctccccctttttttcccctcagtatttgatgaaatgagttgagattgctggtgcccagcaaagcatgacttacctggtaggccaagcagttttgcacagctgagggtttaactcttttaccactccccctttaaaatcattttagaaccatacttttatgaaaaatgtctctcatagtttcctgccttcttttaatgagcagaacaccctcacacctttctttcccatctcccctctttccctggccattgcagtaagaaaaaaggatgatgggacccatttgtcaggatcacatatgagagcagattaaacccacctctactgctaccagtcctgtcccatcacctctggtcacacagacgtccttgtagagaaaatccttgtttgccaaaaatgttagagccattccggggcattttgtccagccacctcggttgtaatgtagggaaactgaagcccagagaagaaaaagggattggcccaaggtcacacagtagcagaggccaaaactaaaaaccacatttccaggtctgcttacttcgagaagagtgcgttttcagtctaagtcagctttgactggaagttctagcaaccaccagcaggtgggagcagatttgtttgaatgtgggatgttcccagcactgaggaatcaaattccacaggcaattggtctggtcgctcatttgttaggggaaacaagcctgaagcctgaaattttgttcttaggtacccttgtgactatgaagattgacaaaaagttgacggcaacgatgaattctcttccagaacttacatcccagaaggccctcccctacttcgggtctccctagaggtaatgcttcattgaaatttctgactcacaagaaaaggatagccaaaatacaagaaatacaaaaatgccattataatttgtacttattgagcgtttgcctagttaatttattataatatccataaagatctagattgaataagcttaaacctgaatatgggataatggtgtaggacaaagaacactcatctggaagttagcccatctgtgttctgacccagctctgcacacgacagtgaatattccagtttggctaaagggtagagtaagtttggaggtaagacaacaggtgagataggtaagaggtgagagattaggcagaacctgactttgtaagcaacacacactcagtgtacaataaattcttgtgtaatgaatgaggcaagagaaagaatctgggtcctaattttctaaaataaaaaattgtattttattttagagtcaacagtaatcttctgaaggatttgtgcaagggaatgatacaatcagagtggcaccttcgcactgaaggaaaaactgggagggagagggactgggggcaagaagagcacacatctccttctggtaatggccagctaggtaacttggactagctgttccagtgaggacaatgaaacaaactggctgaatgtagaaagaaataattgtcataaagaactgagagatactgaggctaaaatccggaagaagacaagaacccaggggggaaagcccagcactagaatcctcttttgtcctgatggcttctactgaatctggaagagagttatgaaattgagctgcagttttggtggcatcataaggaaaaaagtgaaagctcaaggcccaaggaagtagcggatttgattagcattcttgtcactctcagctgagaccctgagtggctacccctttgggttaatggtgacctataagtaaccagcccttgtgtggtcttgtaaacctagatactcatcatatgggcagtccaaggaacctaaagccctgatcttggattaaagtggccttggacaagtagtatcctcaggcatttgaaaataccccagcaaatgaaaagactctgctggaaggtattatcatattgggcctagaatcatttgtacaataatttttcaaaaatatgtcagcgtatagtcaaagataacttggcataaaaggaaacacatagaccatgacagccagtagacaacaaaaacaaactctcaaagacttcacgtatcagagttacgtgacaaagactacaataactatggttcactttattccaaaaaattaaaaataagtttgaaaatatctgtaaggaacagaaaatcataaagactaatagagctattttgaaaaaaatcaaggtgaaaaactaaactataactagtgtagttatactaaagactataacaatgaaacttgagaatttaatggatgggtttaagagaaggctaaacacaactaaaaagagaattattgaattggaagataggttataagaaattgcccagagttctgtctggagaaacaaattatttggaaaaataaaaaagggaggatgagagactcaattagtagagtgagaaggtctgccatatatttaattgaagtcccagttgaagatgacggctgtaaatttgaattcacagattcaaaaagcccaataagtcataggcaagataaattaaaagaaatctactcctagacacgttgtagtgaaagtaaagaaagccagaagcaaagaaggctatattactggtccaattaaaaataatgagttcctgacctagagcaagaacaggagagactgagactaggggatggaagttagaccctggactttagaatgcttttactcatttttttccatgctgaaaaaggcacttgttagaacaacctgacacctatgagccctccctagttgtcatgcttggaaggccattgttctatcggtgtgtgtccgtcatctcatgggccatcaaagaggcaaatattttccatgggtgtgaaatgctagttgctgctgaggtctaaggctggagaaatgtgcttatatatggcttcctaagagaaaccagaataaaagtgaatctttgtagaagagttcccttctgcttaccctgccctcatcattcactatttctaaggaaaaacatacaaaatgaacagttctgtggttctcagggtgtcttcctacacttgggcttcactatatgcaattgctccttgggctatctcatgctggagcacagtaacattcctgcaggggtttatattataatacactgagctacaaataaaataggctgtcttttgagagtgtgggctccttatttgttactagagctgtttatacaaagactgaatgaatggcctcctgtcatgggtagaatagaggaaattctgctccatgtgggaagtggtatcagagctcctgtgtttggctcaaaatccttcatgcatttattctacttgagggacaagcatttttatgtacccttaaggactcttccaccaccaccaccaccaccaccaccaccattaccacagaaatccctttttccaagagaggagagtgggagggcaggaaagccttctctattgcctaacctcaaatcaatcagaatgctgtctgacagtgaagacacagacctaccttcacttatagcatgcagtatgtgacccacaattttgactaactgtcacaaagggagggggtgctgaatttttgattctgaggttccatattttctcttcactttttctcggaattcacattttatgtaggtcacagctccctctctcccccaagcctgcagaaacgggcactgtattaggtatagcatcttctaaaagcatctccctccctaactatgaaagagcaggagcggtgagaatactccactaactctagagtttttctcccaaggacaggttgtatcgtagtgtattaaaggggcatttgattatgaacttgaagatctagattggagctctgtcaccagctattatacctaggcatgtgtctcagcctctgaagctcagctctatcatctggaatatgggggtggtaataatgcctacttgttaatgggagaatccagacaaaaaggactccctttccatcacaacttctagctttgggacctcacctcccttatccagtcagatttctcctttctccatctggaaaggctgcggtcactaccagatagagccactagagggcctcagctctcctggtctaattgtggaacaaacctttccatttatctattaaataattgtttctccgaatccaacaacagcagcaaaacaccttatgcagaagctcactgaaacagagggggataagcacagggagcagagacctttttgaaggaggaagttttagtgcgcaaatggatagacctttatttctacactgcggtagttgctgccatcagctactctgcccctcagtgaggatggtgatggctaacttctgtgcatccctgcccctgttcccaaggggtgagaaacattgatcctgtacaaatcatgaacggatatctcctggagctgtggagggcacagccagagtggccacatgtggtacacctggtgagaaaggctgctttcttacgtgactcccttacccctgtgatatagtttggctgtgtccccacccaaatctcatcttgaattgtagttcccataatccccacgtgtcgtgggaggaacctggtaggaggtaattgaatcatgggggcggttaccctcatgctgttctcgtgatagtgaatgagttctcatgagatcagatggctttataaggggcttttccctcttttgtttggcacttctccttgctgtcaccatgtgaagaaggatgtgcttgcttccccttcagctatcactgtaagtttctcgaggcctccccagccatgctgaactgtgagtcaattaaacaaacctctttcctctataaattacccagtctcgggtatgtattaacagtgtgagagccgactaatacaccctgctagtcttgcacctgtcctcaaatcattttgggttacacaaccccccttagcccctaattaatgtactcttgtatctttagccgtgtgctctctgctcctccctcaggttaagttctacctgaccagaggattttcttttagatagtcttttgacatcagtatactctacatttgtggtaacagcgataattcataataaggcattgaatctttcagcaactctagtcccttgtacttctccaaattgctcaaaaccatgcttttctgcacgatctctgagacagattcagtagcactcacttccatctgcaggcccctttcagttagttggggccatgtaactggttttagacaatgaaatgcaaacataagtggcacagactatttccaggatgaagcatttgagagtcagtttactatccttaagctctctttctttgccctgtcgaccctgaaagccatatgttgaagtgggaatatcaaatatggagagaacctagaccctgagtcttccgatagaggatgtgacctgcatctgaccatgtgtgacctggaaatcaagctttgatatgctaagttgctaagatttagggacttagttatcatttcagcaaagcttagcctaacttgataaatagactctggcactcatctcagtgcctgtaccattagtctaaagtcccatgtacaactctttctgcatgttttacaggtagcttgaatccaaaatatctcagtcttctcctagtactctgcaaatatgctccttttggtgtgttctcagtctcggtggactgatattcagttgggacctggttgggacctataagacatctatagcatttccttctatctccccacccccatattcagaaagtcatcactcattcattgattagctgttcactgagtaccttttaggtgccaggtactactctgagaacagggatataaaagtagaaaaaaaaacagtgaaagaaatccttgatatagtggagcttatattatataggaacaggaggcagattacacagaattgaaatgaataaagtatctggtttattagatgatgataagtgcaacaaagaaaagcaaatcagggaaggagagtagagaatgctgggcaaatgaggtggtaatgattggagggcaaagacattattttaaataaggtggtcaaggaaggactcattgtgaaggcagacatttgagcagagaccttaaagagagggtgtaaagccgtatagacatttacgggaaaatgattccaggagagtggacaacaaggggaaatgcctgaagtttttggtgtatgcaaagaataataaggaggccagtgaggctggaacacagtgagtgaagaagaagagaaataggaggtgaggccaaagtataaacgggggctagatcgtgtagtgacttgtaaaccatgataagaactttgacttttacacagagtgagataggaagctgatggcggatttggacataggaaagacatgagcatatttatatcatgacagtgggatcatgctttttgcctattggagaataggttcctggggtgggggtagggcagaagcacagagagcagtcgggaagctgctgcaataacccaggtgacagatgatgggctcagcagaccagggtggtagcagaggaagatgtgagatgtggtcagattctggatatcttttcaaggcagagttgaaaggattttctgacagatcagacagagaatatgaaattaagagacaagttacaaaggatttccggagttttggcctgactaggtggggtaactgatttgccatttattgagttgggcaagactctgggaggaagaagttaaagtgcatgaatagccaataattttattttgaacattttcagtttgctttgatgttaggcgtctaagtgacgatgttacacaggaatttgtatatatgatcaccactttccctgcccagcacatttctactcatcctttaaggcccagctcagctgtgatgaagcttttctcccaactggccaagcaaagatagtgacctcttccttcatgctacaagggagccttcgacagtcctgtggaacaacatttgactcccgtattgtcattactgcctttcagctgtcttccacgacagactgactgggcactcctttagtccagggactatttctggttcatcttgtgcctgcctagaacacagtccagagtctgggttatggtaggcactcaaaagatatttgttgaatgaagcatcccagaaatgaaaataaattttccataagctggagctcatgaaaaatgaagacttggaaatggccatcatatttattggttagaaggctcattggtgacccctgggacagcagaagcctgagagccacactgaggagtcaggaataggacacccttctgaaagtgttgctatgtggccatttttgcctttcattttgatagtcttgtcagtgtttctcaagtggttaggcgatgaaagggatcaagatttgtgtctccaagtgcacttcaaagagggcatcctcttccctggaagaaatgctgtaactatagtagtgggtaggatttataaggagacagattggcttagatttacttctaatggaggaagcaccagagtcagacaaatttagcagctcaaatcccagctctgccactcatcagctgtgtgacaagtcactttctctccttgatcctcagtttcctcatctgtaaaatttgacgttgtggggattaagtgcaatcaagttggcaaagcgccttcaatagttactgacacagtaattgctagggaagagtggacaaaagagaagcaatagcagggctagccaaagatggggctagcgttccccattcctggagatattcaaggacagactgcattaccattttgtgggaacattatagaaaggattctaatggttggaccagtcgaaaattgaggtccagtctagccttgagttttataattctaagaatcccaaggaatagaaatgcagatacaaatgttgctactgaaaccactctactcatagtggagcactcatgtgccaatgggtttttttccaaaggcttgtgtgtgcgtggcagcattgtctgtgtggcaatgttgtgtgggcagcaatgctgttgctgatttgagagcacactgccagctgtgctgcctgctgctgccacacctggcacactgcctcagcactacatgtcccttccatagtcaaataggcccctgaagtgactgcatgttcattttactctttgactcagtcagctggggcctcccatactaatctctcatttactcctttgcagtataatcataattgactcccgtttggggagaaggcttcaggaggtggtacagtgagaatgcttgctgcttatcttggcttcactgtgtggcatcaccaccgatttttcaatttgacctttgagactatctctgtgatgcttctccccactgcgtcctcctcacaccctgctcctacccccagttcaggccttcatccctgtcttgcactcttgtaatagccttttaattagtttgcccatttggtgttcaccctatctgtaatccactctgattctaacttacacttttagctccttcctcctcctccttcctgtcattcccacccagctccagtgcagaggggctactggcctttctctgagtgacccccacttggcagttattcagtttgtctccttcatctgccaaaattaaatctatcttttaaacccgagaccggatacccttttccccaaagctagctgtgagggttttgactgggtggctctatttgtgtcctgatcacatggtgccttttattggagtcctgtgtgtgcatcttatttcccttaaaagtctgggagcttcatttctctcatcagtagctacattctctccatatctctcctcattttgaaaacaaactcttcttgtccaccatgatttctcccctgaatccctacctcattaaagaaataaatgaataaacccagtcagggtttctgtgggttgtactgaaaagtaattttaacacctgacatcctaaaagcacaaattacataagtaattttagggacgaattgacaatttagaagtctgagtgaaaaaaaactcaggctacaaatgattgattctgctgaatgttgcctaagtgctcttaattaatcaacaaggagccacatttgctcccctgatgaccttttctctcctttagaaaagccaagcccaagggaaaggtgtttaaactgtttatttgattcatttcttagcttctgagcttgactaccttaagcctttggtttgttcttgaggattatggggcttttaagaattgagccattctctagtttgctcttcaggatatgggcatattgcattcatctaatcccttgaatttacagagtgggctagcatagaaaccagaagtgagtagagcatttatttgggcagcatgaatttctgtaaaagaagatgacaggaactcgctgcagtccttctgtcagctcccatgttcctgatgtttataagagcattgcttatgtagtgaatcgttcccctggacacatttcttccacatggtgcctaatgggttgaggtggagcgtgaagggccaacatgcgctagtggacaaacagccaccaaagcgatgtttactaacactttcaccactaaagtatggcaaagggctttcagaacagggtgcactcatattcaagtgcatgacaccgttccagaagttatgatgaccagaaaagctttattttgaattgaaggtgctacttgggagtcagctttagaaataaagtcaaaatgacccttcttgtgttccattagatgtaaatatagtgagacagcttcttcccaatgaaatgcactattataggactctccttatacagtacttcactttagattcacttagattcattaaactaaatgcttgttccagacacctgacttgcaaaatgtactccctattccagcccactgctgagaaaatggccagcctactccagaaaccaataataataatttaatcaccacaatagtgctgtaatctgggtactattatccttccattttccagtcaggagtggagaagacatgatggaggtcagagcttgagctctgaagcccaactgtctggatttgaatcccagctctgacactcactttctgtgtgatcttaagcaaattacctaacttctctgtgcctcagtttcttcacctcaaaggggtatagtaataggaattccttatggtgtaaaatgaattaatacatggaaaatacctaaaacaattgctgagcacatggtcaatgctcaagtaatgggaaatcttctggagttaggtggctgttttctggccaatcagtaagacaaatgggatgaagagaacaaaaatatgggtcattggagtaggccggacttacccgtagttactgggataagctatgtgattctggttggggcagaggcacatgtatagaaaggttgcagaatgcaggccagagggagtcagtgcctgggatgtgtcccaaatgtgtctgccccagcctgaagctcctaaagcctgggagatgaatagaggcctttttctacacacactagactataagaagagttgagaaccccaagtaatatgcaaactactaagttcaacgaaccacaattcatttttaaacaattaattcaccttcttaatttagatgtggcaatttacaaagcaacggaccacttggcatagattttctttgggggacatggagcacagttattggcttatacatagacgcatcaaaaaccctaacaaggtgggaccaccttgtcatgttatcttggaatttctaatgatttgacttggcttcgtgttttattggtactgtacaatttaaatatctcaaacagagtttcattcaaggctctcagtccatgttgaactaaatgatgactccctttactttctagtcacactgtcagggaaatttttacagcagcagcttcagcgtttatactctgctgtcagcaacttcatctcggatatcgatgtggacacggtgctggttcacaatggagcacagggcaagatacaggatttctttacatttccagtttggtatagtgaggtatagtgtgcttaaagagaccaaacaccaccccaccctgccagagagaaaaggagaaatacagcccagcaaagtgtttcttggcttgagtaaggttagatatcatgcccctcacttggagttggatttcagtttctgactacccaaagggtttcacatccagcgacactggcaatgagtgagaagagccccttagtatagattcaccaggctgctaaataggtggactatttagcaggtgatacagtacccctccatccattttttctttcttctcttaaaaataccatctttattaagatataattgacataccatacaactcactgtattaaagcgtacaattcaatgtattttagtgttttcacagagttgtgcaacagtcacctccatttagcttcaaaacattttcaccactcccaaaggagaccctttacacattaagcagtcacttctcatacccccttccccccagccctgtcaaccactaaactactttcaatctctatgagtttgtctattctggatatttcatataaatggaatcatgcaatatgtagcctttcgtgactagcttcatatacttagtttaatgttttccatattcatccacattgtagcatgtatcagtactgcatttctttttaaggctgaatgatattccattgtatagatatgccccatcttgttttatgtattcatcggtagatggacatttctgtagtttccaccttgtggatattgtgaaaagtgttaccatgaaaactcaagtatatgtcttcattgtgtacacacagtgtgataacatctgttttcaattatcttgggtatatacctaggagtagaattgctaggtcaaatggtaattctgtgcttaacttgtagaagaactaccagagtgtttcccatagagactataccatttaaaattctcatcggtaatatataaaggtccaatttcttcgtatctttaccaacacttaacatttacaattttttaaaattatagctatcttagtgagtaaagtagtatctcattgtgtatttttaagaacagctttattgaagtctaagtgatctccaaaacccatacatatttaataagtacaatttgatgagcttatacatatgcacatacccttgaaaccgtcaccacaatcaaagcaatagatacacccatcatctccaaaagtttccttatgcctcttttttgttctgttctgtttgttttttgttgtaagaacacttactgtgacatctacccttttaacaaatttttaagtgcacgtatcatggtgttttgattacctagctttgtaatttatttttaaatcaagaagtgtgatgtctctggctttgttttccttctcaagactgctttggctattctggatcttttttagttccatatgaattttaggattttttttttgtgggggggaaagccattgggattttgatgggaatagcattgaatctgcagatgactttgggtaatatgtacattttaacaatattgaatcttccaatccaggaacacaggacgtttttccatagatcagtttcttctttaatttctttcatcaatgcatagttttcagtataaaagcctttctctacactggttaagtttattcccaagtattatattctttttgatgatattgtaaatggaattgttttcttaacttgcttttaggattgttcattgctagtaccttcaggcgtcacttaattatggggatccattctgagaatcgtatcattaggcgacttagtcattgcacaaatatcaaagcatactcacacaacatagacaaacctgcatggcttgttacagtactgaatcctgtaggcaattgcaacacaatgatagatatttgtgtatatcaacatgtctaaacatagaaaaaatacagtaaaaatatagtataaaaggcaaagatggtatatctgtataggtcatttaccatgaatggaccttgcagaattggcattgtgtcctatacagtagtgtgcataggacattattgcacactactgtagactttataaacactgtacatttgtgctacactaaatttataaaaattctttcttcaataataaattaaccttagcttactgtaactttttgtactttataaacttttaaactttttcactgttttgtaataacacttagctcaaaatacaaatacattgtataaatgtacaaaaatgttttctttctttatatccacattttaaagcttttctctctttcaattttttttgtttttgctttttaaccttctttgttaaaaactaagacacaagaacacacattactctaggcctacacagagtcaggatcatcaatatcactgtcttttacctccacattttgtcccactggaaggtctccaggggcaataatacacatggagctgccatcttctatgataacaatgccttcttccagaatacccactgaaggacctacctgaggctgttttatagttaacttctttaataggtagaaggacttcactctaaattactgataaaaatatagtttagtaaatacataaaccagtaacacagttgtttattgtcattatcaagtattatgtactgtatgtaattgtatgtgctagacttttatatgatttacagtgcagtaggtttgtttacgctagcatcaccacaaacacgtgagtaatgctatgatggctatggcttcactaggccataggaattttttagctcccattataatcttatgggaccgtggttttatatgcggtctgttgttgactgaaatgttgttatgtggcgcatgaatgtatacagaaatatcactaatttttttgtgtttatcttgtatcctgaaaatttgcccaattcaattaaatattttttggggaatcctttgagatattctctacataggatcattccagctctgaatagagcgttttactttttcctttcctacttggatgcctttttctttttttcatatctaatttgtctggctagaacttgcagtatgatgctgagtataaatggcaaaagacagcatcattgtcttaaccttagggagaaacctttcagctttcaccatttatatgatgttagttgtgggattttcataaatgtctcttattttgtgaggaatttcttcccttctatttccaggtatgttgagtgttttttttttatcatgacagggtgttggcttttgtaaaattcattttttgcataaattgagatgatcacctgtttattcccaccttcattctatcagtgcactctattgcattgattgattttcatatattgcagtacttttggcttcttgagataaattccacatagtcatgatgtatactcctcttaaaatgctgctggattcagtttgctagtatgttgttcaagatttttgcatttgtattcataacagatgttggcctgtatatttcttttcttgtctggctttgatatcagagtaatgctgaccttctgaatgagttagaaggctctccatacttttctattttttggaagagtttgagaaagattggtattaatattttagataatttgtagaattatccagtcatgccagttggtcctgggcttttctttgttggaatgttttgattactgagtcaatctctttacttgctacagtttattcagatttggtatttactcttcagtcagttttggtagtttgtatgtttctaggcactacttcactcatctccttcaaccattcttggaaaaatatttattgacattgtaccatgttcaggcactgtgccctgcacaaccagtcacatgttctgcttctgaggaagtgaaattttagtagaaatatacacagtgaaacaagggattccaatacaatgtgatgttgtgatatacattcgaggggcctctgaatcaggcttgagggctcaggaagaaaattgcgtggctggggtagaggtgattggaagttttaatttttattctttcacacctttttaacatcaaccctgcctcaatttataaacaagtcctacttaagagtaaaatgttaaatccaaccacttttctataccttcaccttttcactctggtccagttaccattatttctcaggtggatggacaactatagtagcttctaactggctcccctacctctgatcttgtctcctgtggcaaatatcatagattagctcatttcactctattccaaccccaattgtagtagaccttactaaatgatagaggttggaaagctaaagactatatttcccatgccccataacagcctggattccacagatgatgtaacctctgccaagtagacgaacttgtatgtgatttggaagggggagtgaagcagagtccctacttctgcttctgtgatttctgttttctgttagggagcatggtgctggaagcttttgattcttctgcatcagcagtcacagagatcccaaggtaatgttcctagttttgtggacatcaaaaggcaggtcatggggtgtccacctcgcttatgtagatggagaatgaggtagcatggtcttagagccaagacttgtgatgaacttagcagaggtggtgaggtcctggggccaattactaaggcagtggcttcctgattctcccaatggtgccaattatatgtggtgttattctgggaaacaggtttggaaattcaacctagagtctgttcttttgattctttcaacaattttggaagcaccaaattccccctttctacttaaatgggctaacatggtttctgttttccgtaacagaactctgcactttgctctctacacaaaagctaaaggaaatgttaaaacaaaatatatcctaacttctttgctcaaaaccctccaatggctttctgtgccacttgcaatacaaatcaaactcttaatttcctttcattcttccctggctcgcttcatggaagccctacttgtctactagctgttcctgaaacacagcaataacacccccatctcagggtcttgcatttgctatttctctgtacctggaatactcttcctcttgataagtgtgtggctcagctttctacttcatgccagtcatctttttttaacccacggtagcccagtttcactctctttgacattactgtcttgattttctgcagagcatgcatcactttctgggatcattttgtttacttgatttttttgtgtatcatctggaatacaagtttcatgaaggaagaggccatgtctgatcttttcagtggattctagggaaaaacagttcccacacacattgcaaatatagctaggaattcagaaggaggaagaagaaatagaaaaggctagacatttttgagcactactaggatgtttaaggagtgttagatggcaaagtgccaaagactgaaaacacaaatcacctgataaaggtggcattttccgaagaatattcttgcaattgtgaaacaaaaattatatgtgcaagcagtgtgaataacagccagaactgtgtctgcagtgagtgccattacatcattggcatccaattagaaggctcgttcatgacctgctctgtgactcatttagcattttcttccaaaaaagcatgtacttggtcttgtctggtcatttgggaagtaataaaacagggcatttgggttcttatcattgcaaaaaatcatttgcaaacctctcttgtgtattcaaccctgtactaggcattctgggatgaatgtagggaagggaaaagtcacagatcctatctacaaagaaggtgggtagatgagatactgtccaataagggtcaggcagctgactaggaaaggactatcctgtaggaatcagatgatgtggatgctctggagagggaagaggccacgaagacagagaatcagaaaccacagcatcagtgaacaggagactctgaagtgctttgaaactagggtagaattcaacatccagccttccagccccaactaccaacagctcccaggccacagaccgtaggcatcaactgaactacccaggacaactgccaatgccctgtctcccacccttgcctgggcctcaggcggcttaagttattttctcattgctgccagacactgttacagtctctgtggcactgtgtattcataatcacaaatcttatccagaccctccacactgcttagcattcctactttgtttcctagctagctatctcatcctttctccacaattatagtttatcttgtacatggtccttaagaaccttttcccatagcagattaccttactctcctacttcatggagaaaacagagaactgcaatccgaatgggaatttcctcagttttctgtcatcaaaccttgtgttggtctccagcctcttgtcctccaggcagagtctgcacacagagactactgctggggtcactgataaggtttggctgaacccatctaacaatggaatgttccactgtcttggtatttttgtccacatgaccaaatctagtttggggctgaattgatcagacatttttattcatgcagccataatggaatgaaatatcagatgctgcaatgttgattccccatgttcctgaatcctctgtattagaatctctacatgtgcttgttgaaaataatttttccataaagtaatttctttgtacactaacttttgagaaccactgatattgaccataactaatttgtccaatgaaaaagttctggaatgggccttctgtcacaaatgaaggtggacctgcctatactgtagctgtagttatttaaaagatagggtcaatcacaaaccagagaaatcctcttagaccatctttttttcagacaaatttaaatactcccatagccatcaaaacacacatacacacccagagcctgctctaatgcgtggagaacatgttagccctcaaactcagtgctaaaaaggtgttcaactgtgggaattatcacagtactgtacgatattcaagactttctttgtgaaagaaaacacgcctacagaaaaatgcatagaatgtaactatatggcataaagaataattatgaggtgggcattcgtgtaaccactatccacatcaaaaaaaaaaaaaagcatgaccagtctcccacaagtccttcatggtctttcccaacaccagcccccccagttaatgtgtatggttttttttttatatgcacgcctcatgtagtatatattcttgtgtctggattcttcgactcagtgttatgtttgcaagattcatccaatttgtttcttgtagccaactttgttcatgtactttcctgtgtggtatcccattgatggatatgccacatgttgtatacccattcaactagctttggaatttggattgtgtccagtttgggacaattacaagcaatgcagctctgagccttctgggctgtgtctcccaaggcatgtgtgcatgggattctcgagtctaagtgcctagctgtagtattgctgggtcttagggtaaacatattttaaacttttttgggtactaacagagtgtttctattaatatctaaatacgtatgaattccttccatccaaaagttagtaatatgctatttcatttccagacttcttggtttttatttatttattttttatcagcttttattttgatttctggggtacatgcgcaggttttttacataggcaaatgtatgccatggtggtttgctgcacagattaacccatcacccaggtattaggcccagcacccattcgctgttcttactgatgctctccctttccccgccctctcgacagtccccagtgtgtgttgttccctctcatgtgtctatgtgttctcattattcagctcccacttataagtgagagcatgcagtgtttggttttctgttcctgcgttagtttactgaggataatgaaatgtacattttggtttttaaatgctgtctttatgttattaacttctgcattagcattatgatcagagagcctattttgtatgatattgatcgtttggagtttattgaggcttttttctcttttcctaaattcatattctacttctgtaaatcagcagtgtgcctctaagtaatgtatatattttttgttgggtatagagttttatattgtctaatcactcagatttattactatgtctttgatatcgctgcttatttctgttgtttgaactctcagtttctgaaagtggtgggttaaaatcactagctgtgattagtaatgtgtgtatttctcctgacagtcttaaaacttggtcacctaataacatggtgtaaaaatacaagagcaaaaattgacataactatagggagaaataagcaatcacagttgggtattttaacacatttctctgagtaattgatagaacaagcagaacaaaaatcagttaagtacatggaagacttgaaaaaaaaagtgattaacaaacttgacctgataaagatatatatatatatgctacctctacctctacatctacctatctctgcctatattatctatatctatctgtacatccatgtctacatctgccaaacaattgaaaagtacagcttttttcagcacatgtataacatttttgtaaatgatcacattatgtccagaaagaaaatcttaacaaattgcaaaggattgaaaccatacagagcgtgtacactaatcagagtggaattcagctagaaatcaataacaaatagccaactagaaaaatctctacatgtttgaaaatagtaaatttaaaataaattacagataaaaagaataaataataatgggtacttgaaaataatttgaactgaaaaacaatgaaaataccaagtaacaaaatttgtgggatgcagttaaagtaagaatcaaaggaaaaggaagaaagccttaaaattaatgagctaactattttttccaagaagttagaaaaaggacagcaacactaactcaaacaacagttagaaaatgaaattaaaaactaacatttacagtggtattaaaaatatgaagtaccaacaaaaaactctaattaaaatgtgtaagactttcacagagaatatgacagaatcatattgggagacagcaaacaagactgaactcaatacagatactatattcatagattgaaaggctcaatattataaatatgtcaacattccttcattttattgataattccatgtaattacaataaaaattctaacaggttctatcttgtagaatttttcaatataatttgaaaatttatacagagaagcaaaggtccaagaacaatcaagatactcctaaagaaagtggtgaggaaatttgctctgccaaatatcagtttagggctatagcaattaagacagtgaagtcttagcccaagatagttaaatacatcaatggaacagaatagaaaacccagaaacacctccactccaccatcttctctgaatgatcccttaattttcaggccttaactgcaacctcattattcactgaagacatagcttaccctgaagtcctctctagtggagactctgttctctcatatgccaaataccttagggccagaaaagaggtgggttttcctcaatcctctgttgcttctaggccaaaaaatacctgcccatttgaggtttaagccattccactatgtcatcttctatgcctccttcatgctagcatccactgacctcctagttattctgacttagcatgggcttggtgttctggcttgtgctctggctcatggtctttctctctgctccatcctaccatctttcagaggacttcagtatccacatcaaccacccagcagtttgaccttttcatttctagtgaacttctctaccctgtagtagccacactcatctacacatacagtttgggtttattcttcacctgaaactactctacctctgacagcataagttaaaacatcaattttggattacaacctcctagccatcctgctctctcattctcctattccctctacacctgttctttgatcttattgagatctccatcccttgacctctctatttcttgcccatctgtcctctcttctttttccccctcatctccttattgatttggtttggtgaaactctcctctctacttgcatttttctgtttctatgcagacttactaagttgtaaatacatcacctaccacttattttcctatattttcaacatctcctttcattcccacattcagtaatgaaccacatccaattgttgattctaaattctatgttcttctctatgtgccttcaccaactatcttagatcagcagttcagcatctctcacataagtttctgcactgcattgctgcccctctctgatctttcctccacagtattttcagaatgatatttctaaaatacatattacttccctagttaaagttttctgatggcttcttctagccttaaggataactccaaactactgactttggcatccaaaatccctgcctgcctctttaccctcattttccgtcattccaccttacaaaatcttttcactgcagtcacactcaaacactggcaacactccaagtgcataatagcctttcatgtctctatgactgtctttgaaattgctgtcccctttgcttggaggtcctcttgcctgtcattacttctctctctaagtaactcctcatctttcaaaatgtagcttacctcattctcctatgtgctcactttgaagtatagggcacttatccaaatgaactctggtcattactctgttagccaagatacattgagctagccattagagcttgtgctatacaacagactttgagcaaatcttgggtcagagacgatgccttgttttttgagcctctgattgcaagatcaaggccaggtacatgataggtggtcttttaataaatttttattgattgagtgaagaaatgagtgtttcccatctctcttggacttcaatgtggtcctaatgatgccttggaaaaagtaataaaattgttttccaggattttgaaaacttgtttagcaaaatacagagctaaacgtagagctaaaaaaaaaaaaacagtaaaatcctcttattttttatctaaaattgggtgtgagtcaactaggttgctgtaaaggcctcacagagacctgtcttgtagatatagcttggcaagagaccaccccaaaaggaatccttgaatttatcaatgaattttaagagaggaagaaacaaatttgaatttaacatgtgcataactcttggaagtctgagtagtcgggatacgtaacagagactgatttcaagtaggcctatacagtttggggcccaagcaggccaacttccacatggtttagggtacactaagtaatgtaaaaagtagcatcaatgtcactgacttttctcagccacactgaggaaccctgaagcccacattaactgaaagacaaagttgttagttctagtgcagctgtgaggagacttgcaaagtagtctctaaaactaaaagtcaggaaacaaaaaagagttttaaagaagtgtagtctctacttgtcattactcttgttgtacagaaaaacaggcttgcagcagggaaaatataatgcaaaagttggcagcctttccatggggcctatttgtcaaattttctttcacttcccccaccaaaccatggagttaaaggtggcagttttcttcttgtggggtgcaaaagagtgtttgaaatgagacacaacaatgggaagcctctttatgccttcctctctcagtttggacctagatcaggctagaaactccctacttagagcccaaggctccacacagctccactgggcccaggaacaaggaaagccatgacactcctatcctgttccctcaccataaccttttccaggtctgcctgatagtcatcaagaacacaaggcagaacgcaagaggagggactgaaagcactcaagaaagacccctagagagcctgccaaggccaactctagtaggacaggcaagaaagagctgagctttccttttctcactcttctggagctcttctctcctgcagcccctttggatgcccacatcacaaatcttgattaaaagataaatactgatagatgaggaacaaggattggttggaccatggaaaacactagtctccaggctctggaaacttcctgggattaatcttgggaggtgattcttagcttagagggtttgagggtgggggaagccaagagaggagcaggccgagagctatattggctgtcttgttgattgctacatttccagaatttagaatcaagcttggcacatattaggtgctcagtaaagtaaatgattattaactgactgaatgaacaaacgactgtaaaaaagggcaaaacttcaacaacaaaaattatacagagcacagagcttgtttaagtgccatcaaataagttggtattactagttttgcagagttagtgaagcctttgtgtaaatcttcaatgccaggtttattttgtatatagtagaatccataaaagtttcctcataggaatttgacatgatcagagttaggttttagggggttcagtttggcaatattatgaagaatgtatctgtgggaaaagatatgaaaataacagaaaagttaggatgctatgcaggaacaaaagttcaggcaagaaatagtaaaggcaccagtaagaatgactattacataaaaagttgaataatattgggaggccgaggtgggcggatcacgaggtcaggagatcgagaccatcctggctaacacggtgaaaccccgtctctactaaaaatacaaaaaattagccaggtgtggtggcgggcacctgtagccccagctactcgggaggctgaggcaggagaatggcgtgaacctggaaggcagaacttgcagtgagtggagattgtgccactgcactccagcctgggtgacagagctaggctccatcttaaaaaaaaaaaaaaaaagccaagatggctgaataggaacagcctctggtctgcagctcccagcatgatcgatgcagaaaacgggtgatttctgcatttccaactgaggtacctggttcatctcactgggactggttggacagtgggtgcagcccttggagggtgagctgaagcagggcggggtgtcacctcacccgggaagtgcaaggggtcaggggatttccctttcctagccaagggaagccgtgacagactacctggaaaaatgagaagcttctctccaaatattgtgcttttcccaaggtcttagcaaccgacagacaaggagattctcacctgtgcctggctcggcgggtcccatgcccacagagccttgctcactgctagcaaagcagtctgagatcaaactgcgaggccacagcctggctgggggaggggcgtctgccattgctgaggcttgagtaggtaaacaaagcagttgggaagctcaaactgggtgtagcccaccacagctcaacaaggcctactgcctctagactccacctctgtaggcagggcatagctgaacaaaaggcagcagacaacttctgcagacttaaaagtcactgtctgacagctcttaagagagcagtggttctcccagcatgacgtttgagctctgagaacagacagactgcctcctctagtgggtccctgacccctgtgtagcctaactgggagacatctcccagtaggggccaacagacacctcatataggtggctgcctctctgggacgaagcttccagaggtaggatcaggcaggaatatttgctgttctgtaatatttgctgttctgcaacctccgccagtgatacccaggcaaacagggtctggtgtggacctccagaaaactccaacagacctgcagctgagggacctgactgttagaaggaaaactaacaaacagaaaggaataacatcaacattaacaaataggtcatctacaccaaaaccccatctgtaggtcaccaacatcaaagatcaaaggtagataaaaccacaaagatggggacaaaccagagcagaaaagctgaaaattctaaaaaccagagtgcctcttctcctccaaaggatcgcagctcctcaccagcaatggaacaaagctggatggagaatgactttgacgagttgacagaagtaggcttcagaaggtcggtaataacaaacttctccgagctaaaggaggatgttcgagcccaccacaaggaagataaaaaccttgaaaaaagattagatgaatgactaactagaataaacagtgtagagaagaccttaaatgacctgatggagctgaaaaccatggcctgagaacttcgtgacacatgcacaagcttcaacagccgatttgatcaagtggaagaaagggtaccagtgattgaagatcaaattaatgaaatgaagcgagaagacaaggttagagataaaagagtaaaaagaaatgaacaaagcctccaagtaatatgggactatgtgaaaagaccaaatctacatctgattggtgtacctgaaagtgatggggagaatggagccaagttggaaaacactcttcaggatattatccaggagaacttccccaacctagcaaggcaggtcaacattcaaattcaggaaatacagagaacaccacaaagatactccttgagaagagcaaccccaagacacataattgtcagattcaccaaggttgaaatgaaggaaaaagtgttaagggcagccagagagaaaggtcgggttacccataaagggaagcccatcagactaacagcggatctcttggcagaaactctacaagccagaagagagtggaggccaatattcaacattcttaaagaaaagaattttcaacccagaatttcatatccagccaaactaagcttcataagtgaataatatcctttacagacaagcaaatgctgagagattttgtcaccaccaggcctgccttgcaagagctcctgaaggaagcactaaacatggaaagaaacaaccggaaccagccactgcaaaagcatgccaaattgtaaagaccatggatgctatgaagaaactgcatcaattaatgggcaaaataatcagtgaacatcataatgacaggatcaaattcacacataacaatgttaaccttaagtgtaaatgggctaaatgccccaattaaaagacacagactggcaaattgtatagtcaagacccatcagtgagctgtattcaggagacccatctcatgggcagagacacatataggctaaaataaagggatggaggaagatctaccaagcaaatggaaagcaaaaaaaaaaaaaaaaaaaaaaaaaaaaaaaaaaaaaaaaagcgggattgcaatcctagtctcggataaaacagacgttaaaccaacaaagatcaaaagagacaaataaggccattacataaaggtaaagggatccattcaacaagaagagctgactatcctaaatatatacgcacccaatataggagtacccagattcataaagcaagtccttagagacctacaaagagacttagactgccacacaataataatgggaaactttaacaccccactgtcaatattagacagatcaacgagacagaaggttaacaaggatgtccaggacttgaacgcagctctgcaccaagtggacccaatagacatctacagaactctccactccaaatcaacagaatatacattcttctcagcaccacatcacacttattctaaaattgaccacataattggaagtaaagcactcagcacatatgaaagaacagaaatcacaacaaactgtctctcagaccacagtgtaatcaaattagaactcaggattaagaaactcactgaaaaccacacaagtacatggaaactgaacaacttgctcctgaatgactactgggtaaataatgaaatgaaggcagaaataaagatgttctttgacaccagtgagaacaaagacacaacgtaacagaatctctgggacacatttaaagcagtgtagagggaaatttatagcactaaatgcccacaagagaaagcaggaaagatctaaaatcgacaccctaacatcacaattaaaagaattagagaaacaagagcaaacaaattcaaaagctagcagaatgcaagaaataactaagatcagagcacaactaaaggagatagagaaacaaaaaacccttcaaaaatcaatgaatccaggagctggttttttgaaaagatcaacaaaattgatagaccactagcaagacaaataatgaagaaaagagagaagaatcaaatagacaaaataaaaaatgataaaggagatatcaccactgatcccacagaaatacaaactaccatcagagaatactgtaaacacccctaagcaaataaaccaggaaatctagaagaaaaggataaattcctggacacatacaccctcccaagactaaaccaggaagaagttgaatctcttaatagaccaataacaggcgctgaaattgaggcaataattaatagcttactaaccaaaaaaaagtccaggaccagatggattcacagctgaattctaccagaggtacaaagaggagctggtaccattccttctgaaactattccaatcaatagaaaaagagggaatcctccctaactcattctatgaggccaacattattctgataccaaagcctggcagagacacaacaaaaaaaaagagaaatttagaccaatatccctgatgaacatcgatgcaaaaatcctcaataaaatactggcaaaccgaattcagcagcacatcaaaaagcttatccaccacgatcaagtcggcttcatccctgggatgcaaggctggtttaacatatgcaaactacaatgagataccatctcaaacctgttagaatggcaatctttaaaaagtcaggaaacaacaggtgctggaaaggatgtggagaaataggaacacttttacactgttggtgggactgtaaactagttcaaccattgtggaagtcagtgtggcgattcctcagggatctagaactagaaataacatttgacccagccatcccattactcggtatatacccaaaggattataaatcatgctgctataaagacacctgcacacatatgtttattgcggcactattcacaatagcaaagacttggaaccaacccaaatgtccaaaaatgatagactaaattaagaaaatgtggcacatatacaccatggaatactatgcagccataaaaactgatgagtttatgtcctttgtagggacatggatgaagctggaaaccatcattctcagcaaactatggcaaggacaaaaaaccaaacaccgcatgttctcactcataggtgggaattgaacaatgagaacacatggacacaggaaggggaacatcacactcaggggactgttgtggggtgggggaaggggggagggatagcattaggagatatacctaatgttaaatgaagagttactgggtgcagcacaccagcatggcacatgtatacatatgtaacaaacctgcacattgtgcacatgtacccgaaaacttaaagtataataaaaaaatacacaaatcaataaacgtaatccagcatataaacagaaccaatgacaaaaaccacatgattatctcaatagatgcagaaaaggctttcaacaaaattcaacagcccttcgtgctaaaagctctcaataaactaggtattgatggaatgcatctcaaaataataagagctacttatgacaaacccacagccaatatcatactgaatgggcaaaaactggaagcattccctttgaaaactggcacaggacaaggatgccctctctcaccactcctattcaagatagtgttggaagttctggccagggcaatcaggcaagagaaagaaataaagggtattcagttaggaaatgaggaagtcaaattgtccctgtttgcagatgatatgattgtatatttagaaaaccccgtcgtctcagcccaaaatctctttaatctgataagcaacttcagcaaagtctcaggatacaaaatctgtgtgcaaaaatcacaagcattcctctgcattgttaacagacaagcagagagccaaatcatgagtgaactcccattcacagttgctaccaagggaataaaaagcctgggaatccaacttgcaagggatgtgaaggacctcttcaaggagaactacaaaccactgctcaacgaaataaaagaggatacaaacaaatggaagaacattccatgctcatggataggaagaatcaatattgtgaaaatggccatactgcccaaagtaatttatagattcaatgccaccccatcaagctaccactgactttcttcatagaattggaaaaactactttaaagttcatatgggaccaaaaaagagcccgcattgccaggacaatcctaagcaaaaacagcaaagctggagacatcatgctacctgacttcaaactatactacaaggctacagtaatcaaaacagcatggtagtggtgccaaaacagatatatagaccaacgtaacaggacagaggcctcggaaagaacaccacacatctacaaccatctgatctttgacaaacctgacaaaaacaaaaaatggggaaaggatttcctatttaataaatggtgctgggaaaactggctagctatatgtagaaagctgaaactggatcccttccttacaccttatacaataaattaattcaagatggattaaagacttaaatgttagacttaaaaccataaaaaccctagaagaaaacctaggaaataccattcaggacataggcatgggcaaggacttcatgtctaaaacaccaaaagtaatggcaatgaaagccaaaatagacaaatgggatctaattaaactaaagagcttctgcatggcaaaagaaactaccatcagagtgaacaggcaacctagagaatgggagaaaatttttgcaatctatctgtctgacaaagggctaatatccagaatctacaaataacttaaacaaatttacaagaaaaaaacaaccccttcaaaagtgggcaaaggatatgaacaggcacttctcaagacatttatgcagccagcagacacatgaaaaaatgctcatcatcactggtcatcagagaaatgcaaatcaaaaccacaatgagataaccacaatgagataccatctcacgccaggtagaatggcagtcattaaaaagtcaggaaacaacagatgctggagaggatgtggagaaataggaacgcttttacactgttggtgggagtgtaaattagttcaaccattgtggaagacagtgtggtgattcctcagggatctagaactagaaataccatttgacccagccatcccattactgggtatatacccaaaggattataaatcatgctactataaagacacatggacacatatgtttattgtggcactattcacagtagcaaagacttggaaccaacccaaatgtccatcgatgatagactggattaagaaaatgtggcatatatacaccatggaatactatgcagccataaaaaaggatgagttcatgtcctttgcagggacatggatgaagctggaaaacatcattcccagcaaaccattacaaggagagaaaaccaaacaccacatgttctcactcataggtcagaattgaacaatgagatcacttggacacagggcagggaacatcacacacctgggcctgagggggtgaggggctggggggagggatagcattaggagaaatacctaaagtaaatgatgagttgatgggtgcagcaaaccaacatggcacatgtatatacctatgtatcaaacctgcacgttgtgcacatgtaccctagaacttaaagtataacaaaaaaataaaaaaaggttgaataataacggatgttggcgaagctgcagagaaaagtgaatgcttatacactgttgatcagaatgtaaattagttcagtcactgtagaaatcagtttggagatttctaaaagatcttaaaacagagctacaatttgactctgcaatcccattactgggtatatatccaaaagaaaataagtggttctaccaaaaagacacatgcagttgcaagttcatcacagtgctattcacagtagcaaagacatagaatcaacctaggtgtccatcaatggagaattaaataaagaaaatgtggaacatatacaccatgggatactatgcagccattaaaagaataaaataatgttgcttgaagcaacatccatgcagctggaggccattatcctaagtaaattaatgcaggaacagaaaactaaataacacattctcatttataagtaggagctaaacattgagtgcatatggacataaacatgggaacaatagacacttgggacaactagagagggaaggcagagagtgggtgtgggctgaaaaactacctattgggcgctatgcctgggtgatgggatttctaccacaaacctcagcatcacgtaataaatccatgtaagaaaactgcacatgtacccctatatctaaaataaaacttgaaattataaaaacagcaaaaacaaaattaaaaaaaaaacacccagtcacctctgcaaaaatggaagttgagctgagtttacactggactctcttctccattgtgatggttattacttaataaagactattcttatcaaaaaaaagaagtaataaaggtaacaatattgagttggtgagaatatggaacaagtagagcttttatcctctgtcattgcgagtgtaattagtacaaccactttgcaagtaaactgacattaactagtaaagttgaacttaagaaaactcaatgacctagaaatttcacatctaggcatatgctctagatcagttgttcaaccttgggattattaatatttagagggagataattctttgctgttgctgcggtttaaatgtgtccctcaaaatttatgtgttgtaaacttgatccccaatgcagcagtgtggagaagtaggattttaaagaggtgattagatcatgagagctctgccctcatgaatggatgactgcagttattacaggagtggatccctgataaaaggatgagattgcccctcttctattctctctctctctctctctctctctctctctctcccttcctccctcaccatctctctcttgccacgtgatgccttctgcccccatatgacacagcaaggaggccctcaccagatgtggccccttgatcttggacttcccagtctcaataccatgagtcaataaatttctggtctttataattaacccagtttcaagtattccgttatagctgcacaaaacaaattaagacatttgtggattgcattctaagcattgtaggatgtttaacagcatccctgacctctatcccactagatgctagtagcacccccactctaagtcataataacaaaagatgtctccagacattgacaaatgttctctggaggtgggcaaaattacatggagttgagaaccactgccctagaaaaactcttgtacatgggtattaagagatatgcatgagaatgttcatagcagcatcctttgcaaaagcataaaactggaaacaacccacatgtttatcaacaagtgaattaataaagtgtagaattttcatatcatggataactattttgcagtgaaaaataattactgcagctacacacatcaacatagacaaatctcataaaccaagttgggagcaaaaaggaagaagccaaaatataagacatatagtgtgactgcatttgtattagttcccaaaagagacaaaatgaaataacatattgcttaaaggaaaatacctatgaaatgaacatataaagaaaaacaagtgaatgattaacgaaattcaagatagtggttacctctgggacctcagggagagcataagtgggtttcagaggcttcgatcatattttagctcccatatttggtgatgggtatgcaggttttcattttactataatgtattccttacatatatatgaaatattttattttaagaaaatgatggggtctaaaataaggcaggaggagtggaggacactagactattgactagaatcaataactaagtagatgttaagtgagagagacagaacaaacaacctttaactgcctcttgagtggatgcaggaataattttaagcttgttttatttgtagacttggaaatgagatcaatggctttttatcttctcaataaacaaccatgatccgttgtttaggcttctgaaaaatctaaaattcacacctcaaaattgatctcactacaagatgtgagtcatgggacttgactacatgtgctgcacaatgaaaacaaaactctattgtctgagaattctgccctgttagacttctaaaatgtgtactcatttatattccttgaagtcataaacatctgaaaatagggggcttagtgattcattttctctaactttagcattgttaggatttagcattcccaactgtacattctcaactctacagaaagttatttctaactctggcaatcactctacctcctctttattctcccaatggtcaccctccaggcagaggaatacaaggcaagttggttgctaaatcgcttcacaagattgagccatgaatttggagaacatcaaaacatcttaacctttcccctgtgtagtagaccagtttgttagacacttgggtttatgtaggaaatatgcagatatgaaactgagaattttgggcaatattaagtgacttttcaatgccagtgtgataaaattaataccataaagagtgaagaaatcattgaaggttgctgagcaggtgaatgtcatttttttggaaacttatctgtcagcaagcacaggatggaatggacaagggggagactttggcaggggagaagcttggggccaaacagaggactcgagttcatttctgctatgtcttagccttcaggcattggagagaattgagaagaaagagaaaccattcagctgctccatgggactcagttgccagcttttctctgcctaatccttcagcccctctggccctagagactgattgctaccttctctcaaatattcctacccctgtccaaaaggtgttttgcaatcattggtgattgttctgaaaatgaaagaggcaagattttcctgagaatatgggtgcccagggatatctcaaagggttgttagaagctggctgcacactgggccaatcaagctctgctctgggacgcacagatggacacgtttacacttcatggggaaagaagatgaaagagcaccccctgctggcttgagacttttcagtagctcttcagctcccacctcagcgggtggtggagagcaagtgcctttcttgccagcaggtttatttggaaagtccaggcagatcggcaccccagacctatccctgaaacgtgggttcaggaccccgggcacacatcctgaatctaactttgctaaatggggtcctgtcattccacttctcagagcctcagtttctccatgtgtggagtgaaagtcatggccatccctgaattgtctacctctcagagctgcagtaagggtcccatgaggtggcagctgtgaaagcacttggtaaactgtaaagagctgtgctccagggctgagtcatcactgtggttattatacaagaggatctttactgagctgagcaatgctgtggaccctgtagtgcttaagaaagaattcctggtgctgctgcagcatttgaggatttgacttataacacaatacaattagaaaaagaaactgggtaactttcactgtgaagtgaaggtaacacaagagccatcagtgaggggacctgggagccatcagtgaggagggaccactgctgctggctctatcacccccgatcccctactgactccaccacccactcactccctcctttggacatctctctatttattctttgttcctcttcatttttccattaactgagttcatctcacagtccaccctctgaacctctcaatttttttccattttactgaaatgtttttattctccacttttttcttgcttactaaactctctcttttgcttgccattgtctgtctctcaatttcactctctctctctgcccctctccctttctctgtttctaatctcccttctctctctgtctctctgtctctctctctctcacacacactcgcattcattttaaaccaattctttctgctgctctggtgagaggctcaggaaggagagcctctcagccagtgttgctaggcaacgcagcatcacatggccagccccacattttctgcctgcttctccttctgagctctgctatctgactctgtattacactcagactgggcaggtctgagtaaagaataggcccattggttcacttatagttggcctaaggtgtcacctttcctctgagatatctaagttgctggaaacagagaaggaaaaaaaaaaagctaaggaaataacaaccataacaagatgacattcgtttccacaaacagctctccagagcacggggttcttaacttggtatcatgaaactcctaggtacactatggagagggcacaggggctgcaaaattcttgaaatgtcatgcaaaatcgaatgtttatgcttacttgcatttttttgttgtaagggtttatagtttttatcaaattctcaaagggagtaatgttttccaggaagttcttatcaagttgtctatgctgaatattttgcattgttatccccaccctctgcatctcccacttaccctgctctgacctgcataggttgcttcaatggactcccttgccctctggcttctagttgggttcagccagtggaaggtactgataggaaatcaaagggaagagtaggaggagagtgaggacagagaatgtattcccctgacccacttccttccaggaatttgttgtgcacctctactgaggagcagatcctatctggcagcactctccatatagctaccaacttcttcttgttgagacctccacgggagatctcaagacagttccttctcatctcatgttgcccaggtgtccaggagtttaagaggggcctggactgctgaatggttgtagccaggaattgtttctgctagatatttgatcaatgggctccttggcacatggctctctgttgctggccgctgatggagttttctccagcgaagttcaatgttccctcccttctgactccatttctttctctgtggtttctcccttctttcctccccagtctgcagaatctgcggcaggagaagaaaactaggttacaaatgcttccaaatcttctctgtcttacacctgaacctctggcttttgaaaactcaagagcaaagattttggaacctttgttttctggttacattctgacaacttcccccaaagccatgggttactcacgtctagcatcttggcttgggggtggtgggagggagggtctcaggtaaaaggagtaaagcatagaagagtaaaatgtgcagctgaatgtcccaacaccttatgttgtcacaaccactttatactggctgtagatggattgaagatccaggataatttagtcgtagaagctcccctgcttttttttctgaactaggagtcttttttgaataagactgtgagtgaagaacagtagaaacaaacaaacagggtggacaaagaattttctggactcttcatatgtgtgaaagggtcccatttgtaattaaggacaccatttgggaagtcctttataacccatcagacacaatgataagacttagagatcccacttttccaggtcaattgcatattttcactttccctttttctgttttcaaatcttactggtcattctaaagatactagagtagagcttgcagctgctagtcatgttcacctagactaagatatcgtcctgatggacaatgctgagctggatactgaagtcccttgggattttgctgagaagggcggggaattacagaaccaaaacagtatggcattgtatgcagagagtccatgtctcaggaaggatgttttctttcatttattgcctttgtgcacccagacttgattataggctccctggtggtttcaccttgtgaaccatctggcttaccaaaaatgtctgaataattctggaatgagaggaagcacttacccatctcttatcattaattggttaaggatagtaatcagtatggaaggattttttccccattatttctatttgtacaaacagcccagctggtgatatatgtgtttgtgtaggggcaggggttggggtaggagcaggttgaatgagtacatcagttccctgtgaaattgcttacgtcacaagtagatgattgagtcatttgggtccttcagaaatcagacactgggtcagagatgtaggaacacaaaaggtttactggggagcatctgtgaaaaataaaagggagatgaagcatgattgggctaggagagcctcatatctcaatgcttatctgacaaagtctcacccaatctaacagagagctctggagtaaaaatttcccattagaagaattctgagctgggcagaaatggctaggcctttgcgagtccttggctctggcctgtccaagaagagtgtggtctcattttagaaagtgagatagatcctaaaagtgaagctggaggctgtgatctcactgccctctttgcagctgaactggaagttcttgcttaaagggagactctaatggtagacctcaatggttgccacaatgatctgctgagtttagcagcagaagtgtgacttgggtcacagaatgatgtttgttctataaacctgccatccacaaaattggctggagcctcagggacactcaaagccaatagagataatttctttttaagtattcaaatccacagtgaatctaagtgtttccacggaagctttcatcctaaccatctatcccacgacacactagggccttggggctctaggaatgctcagagaaaaattttcctaataacctggttccttagaaggccatctctcaacctctgagaggctttgcttttgcttattttgtttcagggttaccagagtctattgcatatatttgaagcaaaggcccttccagggcctatgcctaccttctacctgcaacttaatatatctagcgtcacttaagttcatctatttctagggtacagtcatttgtgcaggtcatttttcatagtcaaattgactgctagcctggcatagaagaatttgatcgactcattctacttggtgtatgaagagtgggagtacactttgggttaatattattgatgatacctaataattattgggcacttatttgccagttactgtgttaagggacttacatgatttttctcatttattccttaaataccaacaaatatggtatgcataatttattatccttgttttacttatgagaaactagagacatgagagattaaataacttgccctaattaatatcattaagtaagagggggagctgagattcaagcccaggaagtctggctccagaatccatggtcttaatcactacactgtgacacaggctgcctcctctgatgcagagtctgtatgtcatctcagctatatggactgtgtctccatcttagaagatgcaggaaatagtaaaggacaaagagaagataattcagatgaaagtcattagacttagaagctcaattctgattctacccaggtataaagatagttgggtatccatagaagtggaggtggctgtggcagccaggcaaactagtcagagaatggcatggtgggagtaggtacaggtaaaggattgcccaggaagttgtataccttaaccaacaaggacacttgttacaaggtacaattgagcatttcaggtcattttactcccttatggctagaaataatgtcatgtagacaataatcagcagtgtgacaggggtcctgggagccttgttatacataaaactatggtagaatcccagttctagccaagccaagagtcaagtctaggggagttaagaaaagtaaggaaatgcaaccaggcactatatgtccaagctgattggcaggtagaattcagataccagaaagtcagagtccacaagcaacccacaccagtacataggtcagatgctgatatatgatggaagttttttgggctctgcttgaattctgccttttgtatcaagctttctgatgctagtagttgtgaattgtagttagaaggtgagaagcccgctggcaattcccatccctgaatatgaaaagaggaaccagtattctctcatgcccagaagttgtgagattctcaatgctacttgcagtttattcatgttttacatatatctgctatgattttagtcatattatgcagaaaaaataagcaattacagcaccattaaattttaaattactcagaaacttagctgccataccactgtcaatactggtcttggttttcagtgaattaatccttcacaagaagtatttaaaagttacaattctggccgggcgcagtggctcacgcctgtaatcctagcattttgggaggctgaggtgggcagatcacttgagctcaggagttcgagaccaacctggctaacatggcaaaaccctgtctctactaaaaatacaaaaattagctgggtgtggtggcaggcgcctgcaatcccagctacttgggaggctgaggcaggagaatcgcttgaacccaggaggtagaggttgcagtgagccaagatcatgccactgcactccagcctgggtgacagagtgagactccatcttgaaaaaaaaaaaaaaacctaaaaaaaaattgcaattttaagtttactaaaatcagactcacaagtttaagaagttgagtaatagagtcaagtagaaaaatgaaatttctccgaatgcaattttaagaaaacaaaggctttaagcggaaatcagagagaaatagatttttgtgagaaataaaatttgctgcaaaacataatttgaatgggaaagtgcaagttaagtgctgtttaacttggagcaagaatttagatacatgtggagaaacaacatccctcaaaccatattcttcccagaaaataaaactaaatctagcctccctagttgttctctgtctaacttggacttgatgaacataactatcagaaaaatcagataaaaaacctgggtcttgtgttttgggggaaaatgataccaaataacagattctgtcgacttcttactgaatatctttttcttccactctttgtctttctccttcttttccttttctccagccttccctacttcaatccttcgctttctggtaatgaatctcagagtagttaatacattgcattccaaattgcttttggcttcctggtagtgcttgcttttaggggacatttttctttccaagtatgtgtagtcaggaaacatttttagaagagtagattagaggttgggaaaaaaaaaacccagtccaacagtgttctattctcatttgctctatttaagaatcattagtacttgttaaacactttgtgcttctctcactgagcctggacttttccctgccatagccccattcttcttctcattttctactggatgatgagctccttgagggcaaagcctgtatcttattcatctccatgttgccaacctctaagtcagaagtaaatcttcaacaaagtattgttgaattaatatcccactcctgctttgcaacagtatttctgtctctgaagtggtcaagaagtcaactttcattaattaattaatttaaaatattcatttttggatcgttactatgctaaagattctgctctgacgaagtatatagggagtaacaaaagtcaaatagacaagctattgcaatattgtaagaggacatattgcaatatgctgggaggacgtaggcacagaatctaactaggtaaatagtgtcagggaatgtttcttacaggtaatatttgatctgagtcttgaagaatatgtagaatttggttaccaggtaaaacaagagggtggtgagcagggacaggagcaagtgtaaatgcacaaaagcaggagaaggcgtagaaggttcaggaaattcaagatgacttgaatttatatatatagtatggaatggaaagatgaagcttgagaagtagtgaagaagtagtgaaggcccaaataacacagcacattatatgtcagcttgaggggattaaactttattatgtgtccaatagatagcaacagcagtttgtaacttatgactctggtagcagtatgaaggatagaccagggaaagctggatttgttgcagagaactgggtgggaggctattgcagtagttcaggtgaaaaaatgatgacttgaacaagggtagtgggaatgaatatggaaatgaggaaatgggcccaaatgatacatagaaggtcgaactaaaaagaatcacataaatatggaagggtgagagtggtagagagtcatgaacaacactgaaatgatggtgccaaatacttgaagtagaaggagaaacagacacaggcaggggaaagatgaatacagtttggacacgagtttgaagaacatgtagtatatcgaagtcaaaatggtcaaaacctcctttaagaggttgaataggagagatgggggttcaggaaagtattgttgatatggatttgcatgtcatcagcacagaagtgatacttggaatagtaatatatgagatcagccggggagtgacaaaataagagaggccaggagagagcattgacaagtactaatgtttaaggaagagaggttctgaaggagactgagctgcaccagccaaagaggctgttaacttttaaaatcaaaggctataaggtttctggaattggaaaatgaccccaagcttctgccttctgtggtcccttgccactctgattttagctcctggagataaactttttttaaatttcttgcaaggtcagctatgcattcataaggaaatttgctgtaatttatctagcttcatagtttgtggagcaagaaagcatttcagaatactcactccaccacagtgacgggaatattccactgtattacttttaaaattaaaagcattggttacaacttgataaagggaattgatgaaaaaaacttaaagctaacatcatacttaatagtgaaatactgaatgcttttcccctaagatcaagaacaagactgctctcacctttcccattcaatgttgcaccaaagattctagtcagtgcaatcaattcaaaaaaacggagaaataaaaagcatccatattagaaaggaagggataaaactcatttttttgcagataacatgctcatctatgtaggaaatcctgtgatttctataacaaacagtagaactaataagtgagtttggcaacattgcaggatacaagatcaatatacaaaaatctattaaatttctatatactagcaatgagcaattggaaattgaaaggaaatattctcagtcacaatatcataaaatatgaaatattgaggaatcaatctatcaaagaatatggatgatctatgcaattaaaactaataaacatcactgatggaaattaaagaagatttaaataaatgtagatatatgtcttgttcatggactgaactcaatattaagatgtcagttctccccagattgatctgtagattcagtacaatctcaatcaaagttctagcaggcattttttgtagacatggacaaactaattttaaagttcccatggaaatgcagatgacccagaataaccaaaagaactttcaaaaacaacaaatttggaagacttactctagcttatttaaagaggtactatatagccatagtattggcataaagatagacaagtagaacagaacagagagtccagaaatagacgcctatgtgtgtggtcaattgatttttgacaaaagtgcaaagtcaagtcagtggagaaaatatgatctttttaacctaacaatgctaaaacaatttggatagttatatgcaaaaacaatagcaacaatatcaataaacaaaacccaaaaccaaccaaataaacaaaactttgatccataccttgcacatataaaaattctgtaaaagtggatcatagacctaaacatagaaatgaaaactatataatttctagaaaaaaatcggagaaagtcttgagaccttgggttaagcaaagatttctttgagagggcagaaaaaagcaagatccataaaagaaaaatttgataaattagacataatcaaaattggaaacttttgcagtttgaaaaacagtgctaagagaagaaaaaacaagccataggcttagaaaaaatttttgcaaattacatatctgataagggactagtatccagcatatgtaaagtaattttctaattcaatgataagaagacaacccaatacataaaatgggcagaggatttgaacagacacttcaccagagaagatatattgatggcaaataagcacatgaaaagacgctcaatatcattatttattaatgaaaagcaaattagaacctcaataagatacaactaccccatcactagaatggctaaaattaaagacaccaactattacaagtattggcaatgatgtacagaaactggaacattacacactgatgttggaaatgtaaaatggtgcaaccactttggagaatactttgacagtttcttgtaacaaaatttgtaacaaatgttaagagtaactttatttgaaatagcccccaactggaaaaaaacccaaatgttcatcaacaggtgaattaataaacaaatagtggtacatacacacaatattattcagcaataaaaatgaactagtgatacatattatatcatggatgaatctcaaaataattatgctgactgaaagaagctaaacaaagaaaagtacacactgtatgattcaatttatataaaattctataaaatgcgaagtagtctatagtgacagtgcagatcaatttttgtctgggagttggagattgggaagggatgggaaataatggttgcaagggaatgaggcaatgttctggggtgatgaatatgttcactatcttctttagggtgatggtttcacaaatatgtacaaaacttaaattgtatactttaattgtgttcacttatttgtatgtcaattatacctcagcttctgaaagaagttgattaaaaaatataaacattaaaaaacatgaaacagtctgtgtcttgtttgaagacacagactggctacctgaatcacaaacttaaaatttagagtagtcatcaatttatcttagttttccaaatgcgtgtgaccttctataaatccaccccagcaattctgcttctgtagggccttctacatttacttttttctctgtttctctgaaactataatcctttaataagtttctggcagcgatatttaatttacctgtaaaacaacattagaaaaagaatgaagtaaattactgtacaggatggatgtaggcataaactgtagcatttttgttttgaaatgtaatatcagaactccaagtgaaaactggtttaatgctgcagataaaatgaccagagatgtataaattggatgactccttttatgaacacaatcttaaaataagacctgtttttactcttagaaactcactttcatttggtctattttaatcctactaacttattttaaagctcacaacatatctactctgctttaagtactatagtggcctttggccaaaagcaatacagtgttcatgtgatcagaatattaggaaaaggttccaacagagaaaatagatgaacatcagagctgtcagagatgctcagtaagagtggactcaatgacagagtcctttccttctctgagtcatgaggattctatgatatactatatgggttctcaacctagagtaaaatcatctcttgaaaatacaggcaaaattgcacatatatgaagattttttctggagagaaggttcaaacttttcatttctttgtttactttctttgtaatctgtgcacaggtcattctctgtcttccagttccaaatcatttatagacttacccttttctgaatgtagggtaggacatgggcttcctatttgaagacacagctggggcactggatttgaaattggcagccttgtgtctggttctgattctgccacatactatgtgtgtgacattagtcaagctgccttcttatcttttggcctgtttcactgtatcttcaaattaagagattggattagaaggatgcttaacagccctttcatttccaacttcctagggttctctgtactaggaagctcttgattttatgtcgccttctccaggtctttggtgtttccctcatttgccaaggccctgcatcagggttatatatttctccagctaatggcttctagtcttggtgtgtaccattgccctgcatggcaaagacaaggctttaacaatgacaagaactgttgcctttcctcctgaggctttcgggttctgaggcatcttgtctccttcacattctttgacagaggctaaaacttggatcccatggtggcatgccccactcctatatcccaactatctggatttgatcaaacaccatttatcaagttgtgaccactcttgtcatagaccatcagggcaataagaacccatagaaatcacctagtccatcactcttctcaccatcacctctttgttttctagatatgtgtgagaaagaggagggaagggacttgcagaaagtcatacatgaagttcataaatcaggattaaaacctaggaattctgactccacattcagtgctctttccacggaacctttttttttctttttttggtcaattatattgccaggcataatgccttgttttatctggctattcattcattccattcattctttcattaaaagtcatcacgaatgcctactatgtgccagtcactatgctcattgctggagaaaatgcttccaggagcaagtcagctctgtccttaggcacttccaggctgtagactatgtgttatttcttacagcactgatttgggctaaatgcaacagaacaggtggtcttataaggccctactcaatctggcaccccatcacctgtgccctcacctcctactgtgctccccttggctcactcagctccagccatgctggcttccttgccattccctgaacgtgccaggcatgctcccgtctcagagctttgacattggctggttcctctaccttgatcattcctctgccagacaatgaaggaggagtcagtgcaaactccctcacctccttcaagtttcttttccaatgtcagcttctcaatgagacttaccttgactcaaagttatggatcccccgcccccacaaacactcctaatcctgcttattctgctttctgttattgttttcatggcatatattacctttaaacatgctaaagaattgaattataatatttctcatttattgtctgtcttctccttctgggaggaaagttcccacagggcagtgacctttgttttgttccctcctgcatctcaagcatctaggacagtgctcagcacaaagcaggtgctccataaacatttggtaaatgaatgaatggattgtagtttaaggattttcaagggtagtttgactatacttgattttcagattctgcgtggccttattttctcctttagggcctcagatgtacaaaactaaattgatcagactccactgttcaaggcacaccaacatcattgaatggtggaagacctctttttgctttattttcttttattgttttccatttcatttcccgttccttctacacttccttttcttgggcccacccatgaatatttagggagtgtccgttcaatccaactaatatgtgaatatttagaggcatgtgtgtctttgaaaaatcagagtattgcacgtgtttaatttaaaaattgcataacgttttaaatgcatatctttcttgccccttttatgcaacattatgtttatgagagctaccttttgctgcatgtaaaattaattccttatttctgactgttgtgtactacttcacgtacctaatgatggacattgtagatactccactccttgctccccacagcatcacttcagtaaacattcttttatgtatctccttttgtatttcagtaagcttctcttgggatataatcccaggcatgaggctgcctttctttttttttttttttttaatctttatttttatttttattttttatttatttatttttattatactttaagttttagggtacatgtgcacattctgcaggttagttacatatgtatacatgtgaggctgtctttcttatcttttgcccattttcctactggaatgtctgtcttatacttgtgatttagaagaaatttcttgctcatcctagatattacttttttgctagctttagacattgcaaatatctttctcaccctcctgttaactttgtctatggtgtccattgttgaaaagaagactttaattttggtatagtcaaatccattgtcttttcaccttactgtttgtgcttttggaggtttatttaagaattcttttcgtgtcgtgaggtctccaaattcttagcttgcttttattatctttatagattcacttttcacctttatatctttaatccatgaaaagtttatttttgtacatagtgtaaatagataaacaaatttctatttctccatacaatgagccaattttacccatgctatttactaagtgatttctcttccccacattaatttatgatacctctatcatatactctatatgatatacctctatcatatactaagatcccataaatatacagatgtgtttctgggctattttgttccattggattacttttgagttactgctctgctactacactccttttattactagggttttgcaataattattaatacctagtagctttgtgtagtgcttaaagaaggtgctttctgattattttcaaaatcagtttaaagagtgtggcatacatatatatttctaatatttttgcaagcatttactgctttacataatcacttgaaaaacatttctttttaaacctcagatctacaaatgtagcagtgaagcaatgcaattggaatctcccctggaatagagtgacagcagttgtatgtaagaaatactctcaaactgaaggcatgccagtttggttactttttcatcagattccagtaaacaaactactttctctgcaaccagtggttgtcaggaattcctgctatgctggtattgttacctccaaagtaaaatggtagggctttcttttcttcagtcagctcctttttaacatataacagctgctgatccatcttgtttaaacatcttgtataaatatatgacaaagcagttcccttgtacatcctacagactggtctgctaactttccactgagggtctggagctctgatatattacctgtggagctttctgaatatatgtgaactgtcatgttagaaaattaggttttttttctatcacaaacaactaaactgtaaatttagtaaccctgataaatttttccctttaaatcttaggccacgagtcttttatttttttttatttttattttttattattatacttcaagttccaggatacacgagcacaatgtgcaggcccgcaacacgtgtatacatgtaccatgttggtgcactgcacccaccaacccgtcacctagcattaggtatatctcctaatgctatccctcccccctcccccaccccacaacagtccccggtgtgtgatgttccccttcctgtgtccatgtgttctcattgttcaattcccacctatgagtgagaacatgtggtgcttggttttttgtccttgcgatagtttgctgagaatgatggtttccagcttcatccatgtccctacaaaggacatgaactcatccttttttatggctgtatagtattccatggtgtatatgtgccacattttcttattccagtctatcattgttggacatttggcttggttccaagtccttgctattgtgaatagtgccgcaataaacatatgtgtgcatgtgtctttatagcagcatgatttataatgctttgggtatatacccagtaatgggattgctgggtccaatggtatttctagttctagatccttgaggaattgccacaccaacttccacaatggttgaactagtttacagtcccaccaacagtgtaaaagtgttcctatttctccacatcctctccagcacctgttgtttcctgactttttaatgattgccattctaactggtgtgagatggtatctcattgcggttatgatttgcatttctctgatggccagtgatgctgagcattttttcatgtgttttttggctgcataagtgtcttcttttgagaagtgtctgttcatatccttcgcccactttttgatgggattgtttgttttttttttcttgtaaatttgtttgagttcattgtagattctggatattagccctttgtcagatggatagattgcaagaattttctcccattctgtaggttgcctgttcactctgatggtggtttcttttgctgtgcagaagctctttagtttaattagatcccatttgtcaattttgtcttttgttgccattgcttttggtgttttagacatgaagtccttgcccatgcctatgtgctgaatggtattgcctaggtcttcttctagggtttttatggttttaggtctaacacgtaagtctttaatccatcttgaattaatttttgtataaggtgtaaggaagggatccagtttcagctttctccatatggctagccagttttcccagcaccatttattaaatagggaatcctttccccattgctcgtttttgtcagatttgtcaaagatcagatagctgtatatatgcggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaacacgggctcttttttggttccatatgaactttaaagtagttttttccaattctgtgaagaaagtcattggtagcttgatggagacgacattgaatctataaattaccttgggcagtatggccattttcacgatattgattcttcctacccatgagcatggaatgttcttccatttgtttgtatcctcttttatttcgttgagcagtggtttgtagttctccttgaagaggtccttcacatctcttgtaagttgtattcctaggtattttattctctttgaagcaattgtgaatgggagttcgctcatgatttggctctctgtttgtctcttactggtgtataagaatgcttgtgatttttgcacattgattttgtatactgagactttgctgaagttgcctatcagcttaaggagatattgggctgagatgatggggttttctagatatacaatcatgtcatctgcaaacagggacaatttgacttcctcttttcctaattgaatgccctttatttccttctgctgcctgattgccctggccagaacttccaacactatgttgaataggagtggtgagagagggcatccctgtcttatgccagttttcaaagggaatgcttccagttttttcccattcagtatgatattggctgtgagtttgtcatagatagctcttattattttgagatatgtcccatcaatacctaatttattgagagtttttagcatgaagggctgttgaattttgtcaaaagccttttctgcatctattgagataatcatgtggtttttgtctttggttctgtttatatgctggattacgtttattgattttcgtatgttgaagggcagccttgcatcgcagagatgaagcccccttgatcatggtggataagctttttgatgtgttgctggattcggtttgccagtattttattgaggatttttgcatcaatggtcatcaatgatattggtctaaaattctctgtttttgttgtgtctctgccaggctttggtatcaggatgatggtggcctcataaaatgagttagggaggattccctctttttctattgattggaatagtttcagaaggaatggtaccagttcctccttgtacctctggcagaattcggctgtgaatccatctggtcctggactttttttggttggcaagaaattaattattgcctcaattgcagcgcctgttattggtctattcagagattcaacttcttcctggtttagtcttgggagagtgtatgtgttgaggaatttatccatttcttctaaattttctagtttatttgcatagaggtgtttatactattctctgatggtagtttgtatttctgtgggatcggtggtgatatcccctttgtcgttttttattgcgtctatttgattcttctctcttttcttctttattagtcttgctagcggtctgtcaattttgttgatcttttcaaaaaaccagctcctggattcactgattttttgaacggttttttgtgtcttatttccttcagttctgctctgttcttagttatttcttgccttctgctagcttttgaatgtgtttgctcttgcttctctagttcttttaattgtgatgttagggtgtcaattttagatctttcctgctttctcttgtgggcctttagtgctataaatttccctctacacactgctttgaatgtgtcccagagattctggtatgttgtgtctttgttctcgttggtttcaaagagcatctttatttctgccttcatttcgttatgtacccagtagtcattcaggagcaggttgttcagtttccatgtaattgagtggttttgagtgagtttcttaatcctgagttctggtttgattgcactgtggtctgagagacagtttgttatcatttctgttcttttacatttgctgaggactcttttacttccaactatgtggtcaattttggaataggtgcggtgtggtgctgaaaagaatgtatattctgttgatttggggtggggagttctatagatgtctattaggtccacttggcgcagagctgagttcaattcctggatatccttgttaactttctgtcttgttgatctgcctaatgttgacagtgaggtgttaaagtctcccgttattattgtgtgggagtctgagtctctttgtaggtcactaaggacttgctttatgaatctgagtgctcctgtattgggtgcatatatatttaggatagttagttcttcttgttgaattgatccctttaccattatgtaatggccttctttgtctcttttgatctttgttggtttgaagtctgttttatccaagactaggattgcaacccctgcctttttttgttttccatttgcttggtagattttcctccatccctttattttgagcctatatgtgtctctgcacatgagatgggtttactgaatacagctcactgatgggtcttgactctttattcaatttgccagtctgtgtcttttaattggagcatttagcccatttacatttaaggttagtattgttatgtgtgaatttgatcctgtcatcatgatgttagctggttattttgctcgttagttgatggagtttcttcctagacttgatggtctttacaatttggcatgttttttgcagtggctggtaccggttgttcctttccatgtttagtgcttccttcaggagctcttttagggcaggcctggtggtgacaaaatctctcagcatttgcttgtctgtaaaggattttatttctccttcagttttgaagcttagtttggctggatacgaaatcctgggttgagaattcttttcttttagaatgttgaatattggcccccactctcttctggcttgtagagtttctaccgagagatcagctgttagtctgatgggcttccctttgtgggtaacccgacctttctctctggttgcccttaacactttctccttcatttcaactttggtgaatctgacaattatgtgtcttggagttgctcttctcgaggagtatctttgtggcattctctgtatttcctgaatttgagtgttgacctgccttgctagattggggaagttctcctggataatatccttaagagtgttttccaacttggttccattctccccatcactttcatgtacaccaatcagacgtagatttggtcttttcacacagtcccatatttcttggaggctttgttcatttctttttattcttttatctctaaacttctcttcttgcttcatttcattcatttcgtcttccatcgctgatcccctttcttccagttgatcgcatcggttactgaggcttgtgcattcatcacgtagttctcgtgccttggttttccgctccatcaagtcctttaaggacttctctgcattggttattctagttatccattcgtctaattttttttcaaagtttttaacttttttgccattggttcgaacttcctcctttagctcggagtagtttgattttctgaagccttcctctctcaactcgtcaaagtcattctccgtccagctttgttccgttgctggtgaggagctgcgttcctttggaggaggagaggcgctctgatttttagagtttctggtttttctgctctgttttttccccatctttgtggttttatctacctttggtctttgatgatggggacgtacagatgggtttttggtgtggatatcctttctgtttgttagttttccttctaacagtcgggaccctcagctgcaggtctgttggagtttactggaggtccaccccagaccctgtttgcctgggtatcagcagcggtggctgcagaacagcagatattggtgaaccacaaatgttgctgcctgatcattcctctggaagttttgtctcagaggagtaccaggccgtgtgtggtgtcagtccgcccctactggggttgcctcccagttaggctactcgggggtcagggacccacttgaggaggcagtctgcccgttctcagatctcaagctgcgtgctgggagaaccactactctcttcaaagctgtcagacagggacatttaagactgcagaggttattgctgtctttggtttgtctgtgccctgcccccagaggtggagcctacagaggcaggcaggcctccttgagctgtggtgggctccacccagttcgagcttccaggccgctttgtttacctactcaagcctgagcaatggtggtcacccctcccccagcctcactgccgccttgcagtttgatctcagactgctgtgctagcaatgagcgaggctccgtgggcgtaggaccctctgagccatgtgcgggatataatctcctggtgtgccatttgttaagcccattggaagagggcagtattaggatgggagtgacccgattttccaggtgccgtctgtcacccctttctttcactaggaaagggaattccctgaccccttgcacttcccgggtgaggcgatgccttgccctgctttggctcatgcatggtgcactgcacccactgtccggcactcccccatgagatgaacccggtgcctcagttggaaatgcagaaatcacccatcttttgcatcgctcacgctgggagctgtagactggagctgttcctattcggccatcttggctccaccccatcgagtcttttaaccaaaaggtctatttgggaattattcatatctagagaagattgcaaatttaataaaaagcagatggtaaatttaaataactagagtaccccaaattacacaggactagacttataccgtaatctctattattccttcttgtgtgattgagtccattatctgagcaagaaaacaagcctcagggatgaaagctttcagtaagcaaagaagtttaattgtagaaaaggtctgcaaggcagtccaggctgtaaaaggagtaacaagtatttgaagtggggggaataaaaacaaaaactagaagattagaagattaacaaaactagaggttactgaatttacatttagtttatggtggaaaacaacaattttctcacatgattatcattttttaaaggattgcaacatatctgcagacactgacatcacaaaaggcaagagagaattgtttttcttagggagtcagtaactttcaggaaaggcttaaggattggcttcttttggggaaagaaaactaggtagggtgaccctggtttctgtttgtttatctcagggtgtaaagtatctgttcctcctcattataggatgtgaagtatacagttgcaataataatcatttcagagcaaagtgacatttctgaatccatatgactaataagagttccataaataaataacagaaaaaagtggatgagagaaaatcaccaaagtagtaatagaataaaacatctctaggctgaagaaaaaaatatcaaccttaagtttgaaagagtaccaggcatccagtacagcaaacgaaaattaaaaatttgtcaaagtatattagcgtgaaattccaaaacagtagtgataaagagcagattctaaatgcatccaaagacgtggtgaaacaggttacattcaaaagaacaagatctccaaaatctgagggaaaattctttttgacctagtactccatatcttgaaaatgatcagttaagtgtgagggtagaatagaggcatttttagatcatcaggaatttataaaattcaatccccatgcaccttttctcaatatgttccttgggtatgtgtgtaagaatgaggtataaacctagaaagagaatgacatgagtatcagaaaacattcagccgaggagatcaatgaaggggagtcctgggatgacagttgagcaactggcctaaagaacacccagtcaccatggatgcaggaggacagaggactcagaaaggagcatctaggagtaaaggggattctggagatttatctggatccttaggaatgtggattatcctaagaaggagatgatagaggcaaacaaagaaaacaagaaatgcaaataaagcctccaggaaggcaaaaacgttgtattaggaaaagaatataatacattactgagatgtgcagcaagcaatattgaatagttatagtaatgtaattaccatatattgattttcaacttttagaaccaactatagacaaagcacttttagatttatagaacagaatctaaatgttatcaaccttgacaacaaaagaatacaagtacagaggcagaaatgggtagggagtagaaggtgttaaaaattatacatgacacttgttaaagttggtaaggcagatcttattcgagagagtaagtggtgataggtacagggaccactgcaatggagtcttgcagtggaggacagagattggattcggactccagcatggacaagtggggatttataatcagggagcagggtgggggagggggcatcagtggatagaaaattactaagaggaaatatcaaggataaggagtttctggctaacctgactgacaggattattgctgaaggcagtttcagctgactaaagatttggtcaaaggagagagtctttgacaaaggagagaagaaacaaagggaataggtaacggtgttatatcttcattttacatggagagtcaagggattttatagctcaaggaataagaaatagaagtgcaagtacaggaattcctcattatctgaatctagctcatttctgaaaacatattggaaagcaaatattcagattacagcagcatttttcatgatttgactgaagaaaacccattgcatttgcagcccattcaaaaaccccaacccatttttctagatattactaaaataccctgaaacatttatataacaaccaaccaaagatttctgcataatacaaaacattgtaaacaccatttgcctaattatttaacagttagggaattcattagtgagtatatttgtgagtaataggcaataccacggtagagtattggctctgaacttgattttctctgtgcccttcaatgacgtgtactgtaatataaataaacaatgtaatggcacattacaaataatatctaaatcggacccaggtttagtagttctcctaggaacctggcagaagtaaatgctgggacccattaaaagcaaaaccattagggtaatggtgaggatgatgatgaaaataatgcctagcatatttagacaaggttctaacctcctacaggagtaattcacaacctaaacattttggctgacattacatgaggattcactagagcaagttctcacttcagagactaaattttggatagacatttttacaagaggttatagccaattattggatagtgagagttcagatagctaggtaaaggcgacacataaaggaggcaaaaatggtccgtagttgtatggggaagtggggagaaagactgtgtggggaggtgatgctactgagttaaagccttgtcttccagagatgtcaataaataccattgaaaatgataaagcacccaagagtagtataagcagatggtttagagatgtggtttgagtctccagaagataaaaatcagaatcagctaaaagacttcaaaggagtacttctggagagcaggattggggtcatgtagggaaatgttactttgcattattattctttatattgtttgattttcaaaagcccaggcacgactaaaatatccttcaaagttgcctcatcccactcctacccacttcactttcaatctgaatcaggcgttcctgtgaaccctcagcaatcctgtatcttctattttattgatgcattcaatctattctattggtgcattctactgatggattcaaccaactgcagatcaaaaatatttgaaaaaactatccatactaactacaattcataattatatacttatatgtaatattttgcatacataatacctgtgaagctcattgttctttcttcagtacccagtagtaggactagtataggaggaactcaagacatatttgttttgtgaataaacaaatgaaactctgaggctcagtttctccatctttaaaatggaaatgaaatgttcttccattgaataataattatacgaatcttgcataaacaatgtactgtctgttcaattctatggaaacatcaagacagatgaattttcatggggaaatccattaaattaattgattaggaggtcattggtgaatatggagagtggcatggaaactagagtgcaattgcttagaaagcaagtggtcaagtaaaaggaagagagggacaagtctgtatttggaggagtgacagaactgaggcattaaaaaaaattctgagatgaagagacgtgcatctgtttgcaattctattagtagaatgggagagtgtaaaagccaactggacattatggtaagtaaaatgatccagcctgaaaaggaccaatactgcatgattgtacttatatgagatgccagagtagtcaagttcatacacagaatgaatggtggttgccttgggctgaaggggcagaggaatgaggagttagggtttaatgggagtggagtttcagttttgcaagatgagaaaaaagttctggatggtggtgatggttggacaacaatgtgaatgtactcaatgtcactgaactgtatacttaaaaatggttaaaacggtcattttatgttataaagtacgtatgaaatctaaactgaatttaattatatttttgataatatatcattttcaaaaagttgaaaatacgactgtactacaaatatagaataaacacgtgtcaaatattaaaagaaaaagacattgagatgtctccctaatttcctagaaatggctttgatacataaggacaaacccctctactctgtgaccacagagtggagctgatgtgacctttgtcccctggccatagcttattggtctaagcatacacacctgacacaatatgtgatctttcaaactggataaaaagcttctcttcagtgggctctgaaagaaacatgagattcaataacagagtgcaacacaaaggggagagagacattcttctgtacttttcaaaaacgaacatttagttctatagttttgagagctcatagaggcaacaaatggattcctcctaaacccagaagaatagcacaaaagaaaaccattcctagcaaaatagtagcacttgtaggaccttctgtacccagcagagcagtgcctaattgtcacttgatggggtctgctgttagagctgtgcaaggctgtgcggttggccctctgcatccatgggttctgcatctctggattaaaccaattgcagatcaaaaatatattttttaaaagaatagttgcatctgcattgaatatgaacagagtttttcctgtcattattccctaagcaatgcagtataacaactatttacatagcattgacattgtatcaagtattgtaagtaatctagagatgatttaaagcatacaggaagatgtgtgtaggttatgtgcaaacactacaccattttacatacgggacttgaacatctgtggatttgggtatctgagggagtccagacgccaatccctcacaatactgagggaaggctgtatatacattatctaacagcagtagcatgggctctggcagaagggtgacagacagtgttggactcttgtggctaacagagcagtggagtggagtgcttattggagcatcagcatggagggaacagcatggcccaggggtgcagcagtcattccagcaggagcaaattgtttgtgagcacagaagagacacctaaaaatgcttgaggtggactttgcaggaaacatgtcagtgaaatttgaattattgctgtcagtgtgactttatttgtcttcgtaaaccagagaggcctactaatgtggtgctatctactctgttttgtgttgctgtaacagaatacatgagactgggtaatctataaagaaaagagatttatgtcttacagttctaggggctgacaattccaagatgaaggggctgcgtcttgtgagggccttcttgctgcatcatcccatgtcagaagggggagagagggagagagagagagagagagagagagagagcgagagagagagagagagagagagagagagagagagagagagactgagactcttctcttctataaaaagcctattcctgagataatgacattaatctattgattagggcagagttttcatgacttaattacttcttaaaggtcccacctcttaatgcactggggaccaaatttccaacacataaactttgggagacacattcaaaccatagcaagtgctatggacagcattatctaaatgtgatcttgggagctcactctgggggttgctggacaaccagttagttggaactaacccttccattcctccagagggtgtattttttctaagttcagcttctaataggaccagcagttcctcctctagcaggggactgacaacatctcacatgcccaaagatctcccagtgctgagctattggcattcccaaacaactcctaggaataattagcacctcaaagttgaagtcttaacccccaagtacttcagaatgtaactgaatttggaaatgaggtctttaaagggggtaattaaggtaaaatgaggtcactatggtgggccctaatccagtctgattgatgccttataagaagagaagattagggcacagagacacatagaaggaagatcatgtgaagacacagggagaagatgccatctacaagccaaagagagagccctcagaaggaaccaaccttgctgccaccttgatctcagacttctggcctccagaactatgagacaatacatttttgtggcttaagctccccagtctgtggtacttcgttatggcagcactaccagactaatatgcaggggaaactaaattttcttttctcatgtgcttcttggctattagagttctgctttctctataaagcctatttctgaactcagtggtattcagctttgagcatgcatcagcatgccctcaaggacttgttaaaacacagactgctgggctccaccctggagtttctgactcagtaagtctggtgtagagccagataatttgcacttctaacaagttttcataggatgctgatgctgctggtccatgtgatattgtgggattggtcctgagctttgaatgcacaaacaggtgataatccatatgtgacttaactgggaagatagtgatgaccatgaagaaatgcacctggtattacaggtgcattgaaaggagaacacgataacaaggggcatgctgagtgcccctccccccaaactccattggtggtattatgaatagaagctgtcagcagctgctatgcttgctatcatctaggactaaccctaaccttgtagaaggtgagccagtgggagataggaggggctggtagacacactcaaaggtgacttgcaatgagtcatgcttttgtataaccccttcccctagagtgtggacagtactcaagacttgcttctcaacaatggagtatggcaaagatgatgggatatcatttctatgattatgttacaatatttggggttccttccttgcagagtggagagacctgctgcccttgaagaagcaaacagccatgttgtgagctgcctaagcctctaggtcttgagggaagcttacagttaagagccagcaaaagccagggccctcagtcatgccacacaaggaaacgaatcctgccagcaactatgggggcttggaagaggatattaagcttcagttgagaatgcagcctgactgacaccatcattgcagccttgtgagaccccaatcagaggacccagctgagctgtacccagactcctaacccacggaaactgagaaaataaatgtgtgctatttatagctgcttcacttgtggaaatttgttacacagcaattggagactaatacggggtgagagggggtgggggaaaaatagaggataaatatagccagttgctgtccaacaaataggctagtaactttgctctaagtgattgctttgtttccaagcctgaggccagcagttacttctaaggaggccccagactgacagaaactcgagaacatcaggcagggcctaaggtggagaatgatgaagtaaatacctttttgcacagaattaattggcaactttgagcattctaactttagcagcaccacctcagcatctcaccgcatttgacattcagtgactgaggaacccaggagccagtttgcatgcagggcttgtaaaagatcatgggctaaaaactactggtttaaacaaaaggaccttctaactctgggatgctaatttagttgcccttattcttgagttgcagttcttgccactacttggagaagactcccagcaggagctctggtgcccagtctgatacggcatctattggtcacataggtttgtgcactcacaattttcctatgaaatctaatacacagagctcattgtttgaatctgcagacctagtgaaatgtaagtcatgggaaaagcctgtaacaaattgattgtaatgctggcagggtagaggagggagaacatgctgcagtggcagcaccaaaaaaaaaaaaaaaaaaaagaaaagaaaaaagagttccatctccatgcaagtgcctgccttcattgaggtggatctgaaggctgttcccagcctctttagggattttaatgacgctcttgttcttgtttaggactgttcctccttgaggacctccctatgggtttgctcaggctgccgtaacaaagtgctacagacaggatagcttaaacaactgaaatgcattctctcgaagttctggaagttagaaatctgagatcaaggtgtgggcagggttggtttctcctgaggcctctctctttgccttggagatggccatcctctcctccctgtgtctttatctcctctctgtgtatgtctgtgtcgtaatctcctcttcttataaggacattactcagattacattaatgcctaccctaatgaccttactgtaacttgatcatctctgtaaagaccctatcttcaaatatagtcacatattgaagtacaggggttaggacttcaatataggaattttggagggacacaactcagtccataacaacttctaaatagatatttcagacacaacatctagctcagtcagagactgtgcttgtcatcagtgtaatggtgattgagggacaccatctggtacacagaaatgattacaaattcctttaggtcagtgacaaggatgtaactgtatgaagctggctataccaaacgtggggctccccagcactctctccattagaagaatagcatttgggctttcaactgctgacaaaactagctccttgccaatggcactacctgttaatgggttgaattgtgtccctttgccaaattcatatgttcaaaagtcctaactcccaggaccccagcatgtgaccttatttgaaaatagagttgttgcaggtgtaatgagttatgttaggataagatcatactacagtagggtgggtcaccaatccaatatgacgggtatccttataagaaggggagatttagacacacacacacacatacacacacacacacacacacacacacacacacacacacggagaacatgatgtgaagacaaaagcagagattggggtaatgcatctaccagtcgaagagtggcctggaacagatccttccctcagagacctcagacagaataaaccctgcagactccttgatcttgtacttctggcctctagaactaggagacaatacatttctgctgtttaagccacccggctgtggtactttgttacagcagtcctggcaaactcacacactattagatgggtaagatcccattcaatcttttgacaagttcaatttgggtgtttctcagagaagttggggttctgtattagtcaaggcaattaatgctagcttctgtatacacaattcccaatgtcagtgggttaacacagtacaagtatttttttttcatatagtgatgtctgatgagagcctggtggctctcttggtagttttctaagtgatgactcagaaatccaggttccacagtaactagggcctttgagaattttccactggatctcttaatctgactggttgataagcacagacacacacacacacacacacacacacacatacacacacacagaaagagagagagaaagagacagagacagagacagaaagagagattatggagaaggcataccagcctttttttttttttttttttttgagacggagtctctctctgttgcccaggctggagtgcagtggcacaatctcggctcactgcaagctccacttcctgggttcacgccattctcctgcctcagcctcccaaataggtgggactacaggcgcccgccaccacgcccggctaattttttgtgtttttagtagagacggggtttcaccgtgttagccaggatggtctcgatctcctgatcttgtgatccgcctgcctcggcctcccaaagtgctgggattacaggtgtgagccactgtgcctggcaggcataccagcttctaactgctttgggattgtcagatcctgaggaatggaaattagcattcccagtgtaagatgtactcatatccttgctgcttcagtctaacaaatggtgtgactaccacatgcctttaagaacatttggggacagacagaggggtatatagaaccgttttgcaaatacctacttattttctcctttttgggttcacagtttagctacacttcccagcctcgcatacaagtaagtttgtgcacacggaggaatctccatgtctacctgaagttccaactccactgggacctgaactgtgttcctagatcatctacttggtggtgtttgtgtgaccttagacaagtctgtctcatctagtctttgaggctttctttccctacgtgtccagtgagagttttggatgagatggtggccttgggagggaataggttctttatctaagcaaaggcgggaacccagagagtgtccagtcatttgtgtgaattgaattgtaggtaataaggatgagagtgagagcagactctagacaaacagaatgctgggaggaaagatggtggggaaatttatggtagataacacccactacctatgcattgagccttgcccttctttcagtactgtgtttcatgctatagatttaaagaaaaaagtcaaaaacatgcttatctcctgtactcccccaccccattcctatttccaccatatttttttgttttcaaagtgtgtttcattttctatacacgatacgtatacctggttgggtgaggacaaatctcaggttgaacttccctcctgagcccacatcaggctctgcctctctgactctgtcaatctccatctctctgtttttctttctgtctctcctttgttctattgtacctttctctgcttttgtttgggaatgcagaagcgtcagtttccataatggatctcaatagacaaaatagacaaaatactaatttccattcctcaggatctgacaataatggttctcaatagacaacacgagtattttgaacatggttatagcatttgtttgattgttattctccagaaatcaaagtgaaaaacaaggaaggtaaaaatatcttagataccccctgcaatcacatggaatctactgttatttttcttttgcttgtcctttacaaaggcacatcatccctgtagtgtttcaatcaattagtaacttttctaatcatcaaatattgctgaagaaaaaatataatgacatttaagtgtcagttatcttcatcatcatttattgtcagtaatatgcagaatttcagagatgaatgaaagttgtctgtgggcataggggtccatacattccttaggaactcactcctttacattgtgcaagcttgagggctggtgatgcaagtgttcatttgtaagcttaggtcagatcatcaaggagaccccaacaacctggcaggtactaaccgtgaaatcaaatgatctgagttttccttagggttgctgctgctgtttccatctacatccttccaagattattcagagacttttgtcaggtctatattgtgatcagactgctatatttccccagtcctccttcctcccttttgttttcacagatactacttcacaaacttttttttatgctcctaattctatcccactgcctgtttcccaaagaacccaaattggcacatgcatcatattaaagatcccggaagtggttataggtaagctaaggctgcatgtcaccttgcatttgggcagcaggtcctttcttcaaaggggttctgagtggcgcatctccatatctaccaaaacatgcttaatgtttagtgtcacttttataacaacacaggggtactttctccttctcatttttaagagttgaacttatgtctctggacatatggtcaactaaacattccatagaagctctgttgctacaaaacactcaggattgctgtataaaatacaataaacctcttagctgggttcaggagaaagtaacaagctagtacccaggttcctgactggaggtcagcatgcacactcagaagatccatcaggcctggcagtgccccactgccagtatcatagaggttcactcccaggccaatgcattcatgccagagaccagccccaggaagtgattctggacctctccttccaatagatctggctttagagtaacttcatgacatttataagccccttttaaatctttcagaaaatgtccttagacattttcagcctcagggtttgtcagggggctttcagggggcttgagagtgagtggtagtgtgtcagtgtttctatggatctatctccaattgggactttaatttctagctgaaagaaattctgagtcatggtgctgaagcctcaatagcactttgctcataagcctattctcgttaaatgggaatatttatatactttatgtaaggctcagggttttaatttttttttgaaaagtgactggatttccctccactgaatgtcagtccaggtaaggtgatctttccagtcccttctccaaacaccaaacaccccaatatcctcagataaagatgttggtattaaataaaattattcaacttatgccactgattctcaactggatatgtatagatgagaaagaagaacttaggaaaattgattcaacatacacattctcctctttcttatcctctccttgttccctgcccatcccctccaaatggaaaccagtaatctatgtaactcttaccctcttccttcttgtccataactccagtggtttgggctctcgcactcaggtttttaaattatttcaagttctggaatacatgtgcaggacgtgcaggtttgttacataggtaaacgtgtgccatggtggtttgctgcacctatcaacccatcacctaagtattaagcccagcattcattaggtatttatcctgatgctctcccctcccaccaacaggctctagtgtgtgttgttcccctccctgtgtccatgtgttctcatcgttcagctcccacttgtaagtgagaacatgcagtgtttggttttctgttcctgtgttagtttgctgacgataatgacttccagctccatctatgtctctgcaaaggacacgatcttgttccttcttgtgactgcatagtattccatggtatatatgtaccacattttctttatccagtctgtcactgatgtgcatttggggtgattccatgcctttgctattgtgaatagtgctgcagtgaacattagcgtgcatgtatctttataatagaatgatttatattcctttgggtatatatccagtcatggggttgctgggtcaaatggtatttctggttctaggtctttgaggaatcaccacactgtcttccacaatgattgaactaatttacactcccaccgacagtataaaagtgttcctatttctccacagcctcatcagcacctgttgtttcctgacttattaataattgccattctgataggtgtgagatgatatctcattgtggttttgatttgcatttctctaatgattagtgatgttgagcttttgtttttcatatgtttgttggctgcataaatgtcttcttttgagaagcatctgttcatgtcatttgcccacattttaatagggttgttttttttttcttgtaaattcaagttccttgtagattctggatattagccctttgtcagatagatagactgcaaaaattttctcccattctgtaggttgcctgttcactctgatgataatttcttttgctgttgcactcagttttgaagctctcaatggacaaatccacacgggcttcagcttggggcggatttcaggaataatggctacaggcattggagtcaacctttagggtcatgtggcagccatcacattttttgctacatgcttaggaggtatcctaacttgtatctgcaggtcattctggagttgagacctataatcccatggggagcactagctcttcagaggtgaggtaagacagactatattggtataattgtcaggtttattatcacagaatgtattgtaggcagggtgattgctaaacggagaaattcccttaaactcaagcctggaagctagggcttggtacctgctagtgaaattccctgatgctgatcctcgctttcttggaatataagcattgcccactcctacgtttttcattattatacttgggccacctgttgagatgcttggacccttgtcattcctcttctctaagctgtagcaatcactatacagcacctttgccttccagattgaattgtcccccagtacctataaaagagcctgtattctatgtgcctgtcctgttccattaatccagtactttttcaggtcttctcatccagcctgttttgtcctgcagtgaaccaggcctacctagccccatcctcagctagaataaaagcaaccataaatataaaaagattgagtgagctgagaccatagttctttttttagttctttagattcactaacaactgggttatatttatttgctcacatatctgtctttcatacaagacagtaagctctgagagaagttacactgtccacaggaccttggcataaagtaggtcctctctgaatgctggttgaaattaaaatgaaaagtgtgtaaccagccacatgccctctaagtgacttcagggtctcctcaggacctccccagtggtgttgccactgaccgtcaagggccacaagactccgtgggaagaactgaaggtgctctgatggcaggtaaggggtgaatagggatttgcatccataggttacttcctccacattagtctctcttttaaggtgtgaactcctctttaggatttgcaaggaactgttttgaggcgggagaagtgacaactgggaaaaagttgttttattttaaaaataagacaagaggccccggtgtgtgatgtatacatatgtaacaaagctgcaggttgtgcacatgtaccctaaaacttaaagtataataaaaaaaagaaaaaaatatgagacaagagtcatttttagaaagtacccaccagcgagtttgaagtccattactggcaaactgtccaaatggaaatacaagttttgtgggcactcgtggagtgaggtgaccatcagcaggagatagcatggggttatggagtacagatcactccaaacaatttaattttcatcctctctttctttcctttaaatttttgattgggttctttactatccttgtagaccagggaaacgttgaacacagtgtatctggatttcggcacagcatctgacaaagcccttcatgatatcttcatgggtgagatagacagaagggggctaataagaacatgattaagttgatctctaattgctcgaatgaccataccccaaattgactgactacatcatgaatattatcaccagtttacagatgaaacaaagggaaattaagtaagacccatgatcacataactagccttggggtattttcaaagtactttgtataaatccaaggggttcttacatcagtttttccttataaaatgtggcacaaagtaatcgaacaatcaggctcctgtctttgctttggttcgcaatgaaatcagtgatcatcagggcctgtttgcctacaaagatcagtttgaaggagaaagtggaagaaagataaggaaaactcagagactgttatataaatggatcacaaaatgattccaaatgataacactgggttctgaagaacatgaaactaagtggctggataactgcctatcgacagatgctttaagatgatttagttctgcctcaattcatgttaaaatagaaacagaacatgtgaaatcggtggagcatctcattgggtaaaataagctctgggtgagcaagttaacaacgtgacctagatggcaaggctctctttcccaaggaccatgtcacctctttattgtgtgatatgctaagtgtaaaaaggagggtgaggaattcactgtggggtgtgtgggtgtgtgcatgggcaagcgtgggcatgtatgtatttgcatttatatatttaatcatatatgtgtgtccagggatatactgtatgcaattaagggattattaccaatatatgtccttatgcaacataacacaaagtaatctagtaatcagatctctcttgtttttgccttctgaagaggtactcagggcatgtttgcctacaaagatcagcttgaagtagaaactgagaaaaggataaagaaaatcagaggctgctagatgactacatcacaggaattttctaaatgataacagtgggttatgaagaacatgtaaggaaaagataaaaataactgccatttctgttctgattatggtggctcctatttaagtctcccatcgctaatgccttagataggttttgctcttgatggtttgcaaaatattttcacacatgtcatcttgttggattttacaacactgccataaagtaaaaattagggattaaaaacaattcccattttacaaataattcccattttacaaataagcaaactgagcaccaaagaatggtagagctttgtccaaagtcacaatggggaccgtgacaaagctaaaactcaatttcaggtctctaggcccttatccagtgttctctttgttaagtcacatcgccatcccctttcggaggcattttctgtgtttcctctttccactacttctattgtttttcatgcccttagctactagcttctccattccctttctgccttcctcataatttctttcactcctgatttggatagaatctaaggcagaaaatagatgtgtgagctggtgccagaaaaccatgtaaatttcccaactttaaccctaggtgaagaagtatagggttatgtgttttgtgtgtgtgtatgtgtgtgtgtgtgtgtgtgtgtgtgtgtgtgtgtgtgtgtgtgtgtgcatgcgcaagaatgtaggggatggggaatgcaagaggtggggttcaggtgagtgttgagatcagcaatgcagagagtcaggccaagagtaaaacttcaacctcgaccatggttctcaaaatgaagtttcataatagaacatcacctctaccaacctcttgactggttttcaaaacatacaggtgtctgctctcaatcagtaacaaaaaccttcacaccaaccattgtttaatagtaaaaccttaagttatctgttcaaaaactcaggtaaatgaaatgattctgctaagttcttcactttaggtttcagtaaaccatattggatctacagcgtagtattactaaccccaagctcttaggttacaacttgtggccatgtgcatcattgatagagaaatccccccaaaagtaagcatgcctttcttttttttctatatgttttaaaaattgatttttaattgacacataataattgtacatatttatggggtacatagcgatgttttaatacatacaatgtatagtgatcagatcagagtaatcagcatatccatcatctcaaacatttattatttctttgtattgggagcattcaatatcctgtcttctagctctttgaaaatatatgatatatcattgctaactataataacacaacaatgctatagaatactagactcattcctcctatctagctgaaattttgtatcatttaacaaatccctccttattctctccctttccctctactcttctcagcctctagtaacctctgttccaatttctatttctgtaagatcaactttgtaagattgcacatatgagtgagctcatgctatatttgtctttctgtgcctcgcttatttcacttaacataacatcctccaggctcatctatgttgccatgaataacaggatttcattcttttttatggctgaatagtattccattgtgtgtatatgtgtgtgtgtgtgtgtgtatatatatatatatatcacgttttctttatcagttcatcctttgaaaggcacttaaattgcttccatatcttggctattgtgaatggtaccgcagtaaacacaggggtgccaatatctctttgatacactgatttcctttcctttagataaatacctagttatgggattgctggatcatatggtagttctattcattgttttttgaggaacctccatattgttctctgtaatggctgtactagtttatatccccacaatcagtgcataagtgttaccctttctctgtatccttgcctgtcttttttatttttaatcttttttatacagtagccattctaacagatatgaggtgatatctcattgtggttttgatttgcatttccctgataattagtgatattgagcatttttaaatatacttgttggccatttctttcacactgtgcagagtaacctgggaccagcacactacctccaatagcttttgtcatggaaacttatatatggagagaagaaaattaaacacttgaggtttccagactagataaggtgggcattttagctctctgaaatgccactccctactcaacaacaaaaatagaaaatgagggtcaagtaatggaagaagaaacatgcttctaatatttcaaatatgcaatgataccaaagggattgacatcattgttgtgatttaaattccaatttggttttgagtttcctagtagccatgacaaaaatggaaaatggtctgaaccacccttccagtccatgagaatgtgactagtactagaattacttctttgaaacattaaaaaaatattaaagaactttcttttgttttttactatatccacctccaatttaaccactaatctcctatcaacagtttttataagagaaatgtttttttctaatctcagaaaaaatagatatttgggattgcgatggactcaacacttaaagaaatacattgatatgcctaatttaattcatccattcctgtcattccttggcttggaatttacttataggagaagtaagacaaggtgtttttttttttttttctttgacagggtgtattagtccattttcacgctgctgataaagacatacctgagactgggcaatttacaaaagaaagaggtttaatgaacttacagttgcacctggctggggaggcctcgcaatcatggcggaagtcaaggcggagcaagtcacatcttaggtgaatggcagcaggcaaaaagagggcttgtgcacagaaactcccgtttttaaaagcatcagatctcgtgagacccattcactatcacgagaacagcataggaaagacccacccgcatggttcaatcatctccccccaggtccctcatacaacacgtggggattatgggagctacaaaatgagatttaggtggggacacagagccaaaccatatcacagggtcttgccctgtcacccaggctggagtgcagtggggtgatctcgtctcactgcaacttctgaatcccaggctcaagtgatcctccctcctcagcctcctgagtagctaggactacaggtgagcaccactacacccagctaattttggtattttttgtaaagatggggttttgtcgtgttgatcaggctggtctccaactcctgggctcaagagttctgtccaccttggcctcccaaagtgctgggattacaagcattagccaccgcgctggactgttaagtttgtttctaatcaataatttacttatgcaaatatgtaaaaaacatccatgttgcttgcaaagtgattctaccccaagagactaattgttttaatgcttgctagtttggctgtgcttctccatgttggggagcctttagtagctattctttttttttattattattacactttaagttctgggatacgtgtgcagaacgtgcaggtttgttacataggtatacatgtgccatggtggtttgctgcacccatcaacccgtcatctacattaggtatttatcctaatgctatccctcccctagccccccatcccgctacaggcccccgtgtgtgatgttcccctccctgtgtccatgtgttctcattgctcaactcacacttatgagtgagaacatgcggtgtttggttttctgttcctgtgttagttttctgagaataatggtttccagctcttaagaggtatttgcaatctctgtataccctttgccatgcaagactgacattccagagactgttcatttcacccctgttttcttgcaatttaaataagctgctaagtggaaggtgtgttttggttgtagtatcacatcatgaacagctctgcacgataaacagaattaaagagtattatcatgattttccactaatttacatttttttccatagagagtgaacactttactaaatcagctatgcataaacagtaactagtattaacataaacattaaatataaataggatataatttaaagcaaaatttagggaactacaaacacctgggtacaattaggtatcttactcatctttgttacaaattccaatcttttatttgttctgctttgggctttaataaaaaaaaaaatttaaccctttctcttacctctctgcagcatgtaaaaaggctttgccttgtatttagcattctaactgttggagtgacagttatagcattctgtggtggccacatgtaatggggtggataattaaaataattctctcattatatgaatatatcacagcctaatactgagttaattccccaagtttccttctttacagatatcatctttttttctgtaagctactacacaaaaattcgaatagaatatgttacagtcatgttggactgccccatagttcaggccttagattctgaactctcttactacactttaatcttatatgatttcgtctattgccacagatttaaatatcacttttgtatatggctacaaaatttataactctattcaaactgcctacctgagtttccacttaaatatcttgtaggcttctcaaacttactatatcgaaaaccgaactgattcctctaccaccatctcaatcctctgcagtcttacacttcagtaaatggtaccaccatcaacccagctgtttaaactcaaaactttggaatcatccttgattcctgtcatttctcatcctccatggccagtatatcagtgtgtcatattagttctacctcttctccacattgccaatgccaccaccctggtcccagccaccatactgtgttgcttgaaccatggccacagcttctgtgctgagctccctgcctcctaccttgcttcctcacattctattttccttcaaaaactgaaaaccagtccatgtccattttgatcccctactgaaatactttaaagacttcctgtagcatttggaaaaaaattcagaattatccccataactataaggctctacatgatctagctgccccctaacttgtcaactatctccctcagggaactgaaacccagttgggcctcctttgtttttttttagtttaaagtgcattgctatctcaatattacattataatttttgttctctgcttgaggctttttcccaggtcctttgaatgcctggctccttgttatgcttcaggtcttagctcaaatatcctttctcagagtagtgttcctgacaatgccacagtgcctctaatgctccccttaactttctatcacattccccagttttatttctttcatatcacttaccacaaattaaaaatatcttattgatttacttgtttctggtatgtctttccccagctagaatgtaaggttctcaaaggcagggaccttgtatgtattgacatttctgttctccagaatcttaagctctatcaggaactgctgcctacataataaatatttattaaactgcaaatgaaggaattcaatatgtctatcaacagtagtatgaataccagattccccaacccctgcctttttttaaaccaacattggattattgtggtctttcaaaagagtgaaacttctttatacccttaatgactactttgggatttatataattaaagtgtggtgaataaaacctttcctgccttattgttcccattgctagagaaccaattctgccagtgatagcttctgaataactccatgggctaaatagggccacatacttcacggactttctaagaaaccattgcacactctagtagaaatggacaaccagagtaggaagcgggtagttgtcaagagggcaagccacttttccattgcaagttgtactgagagaagcctggccggcacttgattgagaagaaatgctttgaaattaaaatttgcaatttattgaattagcctgcagtgggttgttttcttgttgccagcgtcctgaatgctatgagctctacctgagatgtcattaggagacaaggacatagttgaaggcagtgatgaggggatggaggaaggaatttcatgtttataatccaccaacttctgacttttaaataaagagcttatggttataaagcttatgctttcttagttattactaaaattacaaagcctacatgacttttaataaatattttctttaaaattacccatttccagctacaaaatgcaaactctttgagaatataactagacaaaaggtagagttgaaatcacaatggaggctaggtgcgtgtcctttcctatcctaaatttcttaatatgctggaaagatattttaaaatttaaacaaactcaagacaactaaaagaatcacacaagtacaaacaaagaatacaaatccacctaaaatatccatgggaaattttaaaaattgaccatattttaaggtaccaaaaattttaattcctgcattaatcagaattggctagattgtgctgcaattacaaataaaccctgaaatctcagtggctgctcaaattctctctcttacacttctctcttacacaaaatctgatggaagctggatttctctaatctatcttaatccacctgaaacatgtaaacttatatgttgccaagacagggcaagagagagctttaaattatctgatatggtttggatgttttgtcccctcgaaatctcatgctgaaatataatctccaatgttggaagtggggcctggtgttgggtcatgggggtggatccctcatgaatggtttggtgctctcctctctgtaatgagtgagttttttctctgagttcatgagagggatggttgtttgaaagagtgtggcacctccccgtcccttgctttctctcttaccatgtgatacgctggctcccccttcaccttccaccatgactggaagcttcctgaggccctcatcagaagcagatgctggtaccatgcttcctgtacagcctgcagaactgtgagccaaaataaatctctttcctttacaaattacccaccctcaggtattcctttatagtgatgcatatgggctaacacaacctcagccccaaagtgagacatgtaccttctcacaacaataacaacaaaacagtagacttgatccataaaaccaaaagcttttttttcctaaaaattaaataaaattagtcaaatgtgacttaaaaagccagaaaaaacacaaattacattagaaatgataaatgaggtataaccacagacccagaagaaactttgttaaaatattgtatttaacctctactggtaattttgtaaattttttaagagatggaaaatatgaataagaataatgtctgaatttctgatatagttttagaataattcctatacagagataattaataattatagaagaaattaaaaaggtaaccaaaagtttgcccctaaaaacaatagtaggctcaagtaattttatgggtgagttatatcaaatcttcaagaaacagataatctctatattatatgaacagttttagaagatagagaaatatggaatgtcaactaacccattatacaaagccggcaaaataatgatactaaaaacaatcaagataacacacagaaaaggaactatgggttcatttgtgtacaataataacataaacttattgagtacattctgtcatgccagacacagttcaaagccttgtaagtactatgctgtttcccaaaataatgaagaaatcccacctttagcagtggtggaataggttgctttataccaatcctcctgctgaagacagtgaatgaagctcaataataatatttcaaagcacttctttggagtcatcagggaactaacaaggcagggaggattttcagggccaaggtcccagacagaagcccagggaggggagtctggtattttatgctgctttaccctactaagaaattattgattctgaaaagtagtggatgagaggccaagcagctgagctgagcttttgacagactcatggaaagcaataaattaagagctcaatggatagatttaagaacaaattaaataaaactgaaaagaaaattagtgaatagaaatataattttgaagaaaaaattttagactgaagcacaaaagggacaaaagaataaaaatacagaaatgaacgtaagataatatgacatagtgtgacagagtctaacatatgtgagactggaatcctagaagaagagagaagtgatgtttaagtagataatgactgagaattttctaaaattgatgaaacatattgaaacaaagattatgaaagtcctataaaattcaagcatggtttctcttgtatacattatagtcaaactgctgaaaaaccaaagacaaacagaaaatcttaaaaccagccagaagaaaaaggacatatccttttcaaaggagaaactgtgagattgatattgacctgtcaaagaaacagtagaagccagaagcaaataaaatgacatctttaaaatagtgaaagaaaataaccaccgacctggaattctttattcattaagttatctttaacaaatgaagggaagacacagacattttcaaataaaaagtaattaagggaattcatcaccaggacacctgcactaaaagaaatacctaaatactgcttttcaggcagcagaaaaattatcccaagtagatgcaagaaagaataaagagcaatagaaaaggtaattattactatatggaaaaatctgaataaatattgcttctgtttacacaaaaataacaattaaaaaaaacattttataaaaacaacaaataccacaagtggcaggagggagtaaatggaattggaatgttttaaggtccctgcatacacttgtgctaatttgaaaaacaacaatgcatgttacaatctctagattaaccattaaaggaataagcagattaaaaaaatcagtaagtatatagaacatgtgaacatggttaacacatttgacttcattgacatttatagaacacagcatttaacaatggcggaattttttttcaattgcacatggaatatttaccaaaatcaaccattattggaccataaagcaaggctcaacaaatttcaaagggctgaaatcgcatagattagaatgtctgaccatagtagaaataagctagaaatcaataacaaaagataactagaaaattaccacatatttgaaaattaacacacttaaaaataaccaatgggtcaaaactggaatcacagtgaaaatttgaaaatacttagaactgcaggagcaaaaatgaaatataaaaacataatggaaaggaagaggcaaactgttattttatgtgtttctaattataaaatccaagaaaaccaaccggaagactactggaacttataagcactcagagatagctgattaccacataaaaatcaatagcttttccatacagtagcaaaagctgattagaaaatgtcatggtgaaaatatttcacattgcaatggcaagaaatagtataaatacataaaaataaactgaacaagaaatgtgccatactaaatgaaaaatgttatattttgctgatggatataaagatggatggaaattgagaaacatacctggaacctggatggcatgcagtgtagggttaggaatattgactctggctccaggaatctggagcccagcctgctcaacttcaaatcctggctctgtcacttcctagcagtgtgactttggcctattacttaaacctctttgtgcctcaattttatttccctgtaaagtgtcagtagccatagagttaaggttcactgaggaatcaatgagttattctaccatgattaacctatataaggctgtgtgacctgcaccctgctctcctgattccctgtatcctactttccctcctcattttattttctatagcactaactaccctctagcatatgatatcatttacttatttttgtttgtttgttttgaggcagggtcttgctattacccaggctggagtgcagtggtgtgatcatcactcattgcaaccttgatctcctgggctcaagcgatcttcccacctcagcctcccaagtagctgggaccacaggcatatgccaccacgtccagctaatttttaaactttttgtagagatgggatctccctatgttgcccaggctggcctcaaactcctggactcaagtgatcctcccgctttggcctcccaaagtgctgggattacagacgtgagccaccgcaccaggccgtatttcttatttattgactgactacctctgccaaaatataagcttcttgagggcaagaatctctgttttaattttttgacataagaaataaaataaaatataaatacatgtctatatttttgaaaatataccccaaatgcttagataatttacttggcacctggcagggaaaatagaatcatacctggtacacaataagcactattattatagtaaagatgtcagttctccagaaattataaatgtaatgcaacccaattaatatcacagtgagatgttttatagaatttgagaagctgattctagaattcattagaaagagaaagcaacaaaagcgaataaaactttttaaaggaacatggtaggaggggctcgtcttgccattaatcagcacaatgacttattggcacaggaatagacaaatagatccgtgagattgtgtgtgtgtgtgtgtgtgggtgggtgtttgtaaagatagcatttcacatgagtggagaataaactattccatacctagtgtgggcataattgactgttggttatctttctataagatctttcccacaccctcccagcttaaaagcaattcctaatggactaaatagcttctgtttttgatcatctactaacatgatttttaaatcaatattttctcattactgcttgcaatgattttcaagtagttaagcctgagttctgttgatttaagttgagttccaaatcaaaggggctctggttttaattcctgcacctgctactaattttctttgtgtccttgagcaaagcacttcccctttaagtgctcagttccattgtctacgaagtgagaagtttttattcaattaattaagatacagacaagttcaactaactgttaggtgattttaaataatcctcacagctcattttcttcctattttatagttgaagaaactaaggttcagaagaacaatggcctgtccaggatctcacaaccagcatctacttgttccagttcaagttaggtttggctgttaataacatcacctggtggatcaaggtagaggtttgggttttttcccagtaaaatcagcacagtgttaggcagtccaaggatagttttaaggaagaaggggaaaataaaattgactcaacaactagcatttcggttacagtggtgaaatctcacatccaggtctactgatctatgtgtgatgctcttttcattaaatctatagacctgaccctcagatttgtagagacaacttggagagaagatcaacatagatttcatggagggaatggcactcgggttgtgcctgcattgatggctaggaggtggacagttggagccgggattcagggaatgctttgttgtggtgggaacaggatggtcatggactgcaaggggaggggaaagatgagggacagggtgtggctaagattgattgggtccagcatgggtaatgggaggctggcagtgacccaggctgctagtagtatggcttgtagagcatagtttcttaaagacattaagacattattcatgaaagacattatatgcctgggggaccttggcatcccctgccctcaaaaaattaaaagaaaacaaacacggtaccagcagggatggaacaggctagaggctaggggatggcactttatgtggagagttggctcaactcaaaaaattagctcctgcttgcctgtccagggttgctgatgtctctcctttgggttcaggtagcagttcctaaactttgctgtacattggaatcacctggaatcatctttaacaaacactgcccactggctcctgcctttagagatccgatttgagtagtatggagtgtaacctgggcttcaagagttggaaacgctctgtaggtgattggaattcttggtcagattcgaaatccaccaggtgaaggcattgaatgcgaaatgttaaccgtgaattatatttggtgccattatgattacatataacattgtatataatgttacctattattattgatacagttttccattatataggcaggctgggagacagtcccagcccagccctgggcgcttgctgccgccttgcctgcagagccactaacccagagggcttcacacagtgaggagggtgccttatttggcagtatctaactctgaggcgctgcatcccccgttagcactttcacaagatgctttagcacgcatttgaggccttccgggttgaaaaaccaacaaaagcaattgaaaagatgaatttcctgggatttaaaaggtacttataatcacatctctcttgccaccccctgccctcccaactagtgggttggttggtctcgtttcagttgtgtaagagctcttttagcagggaactaaaagtcctgggctagagttggcagggtcggtgggtaaggcttggcttgctctgggggccagggcagagctctggagccagggcgtgtccatttggtcagggaccactccccatccccgacttttctgggctccacgggctctgcacagtcaagctgtttcctgccttatcagcaaaggagctggagaaatggagaagtgacagccatctgtgtaaattaactcattaccagtaaaaaatttgcaacacctggtataaatttcgctgagttcaaagttgtagcagataaaggtacaattaggctgagaagctgcctattggtggccgggtaggtgagagtgtgggcgaagggcttgcagagccacagtggggctctgtttgcaagtgggagcggaggctgggagttagtggcctgctggcctcctcagtgtttagctgaaattgctgctattgtcaatagagattgacaatttaaagagctacaagagccttgtctgctgattgaatttatttatcagccgcatatttttgatcatgagtagaggtggcttatcaaaaagacgcgacgtgatgatgcataaaccattttgttttgtttagcgaaagttgaagtaaattacatttgttatttcagtattgcctcgtcaaattctcaggagaacaataattctagagctcactcagagtagagcagaccagctcaattattaaagtattgaaagggaaggctgagcaagaaagatttgctgttgtagcagttcccttttcctgaagcatttccccttcaactgatgggaaaaagagtgaaggagaaggtgcaggaaaggagaaagggcagttgttgttttgtagctggaggcttttatttccccagtgagggccaggtttgctgaagaaagaggtctatctatgaaggttttggtgtaaaggttaataggatgtcagagaaagtgagaaaaagggaaggcacttggaaaaggatatgaatgactttcaaagagagattctatttgattgtaaaaaaacagattacaggtcaaataagtacacagtaaagtaataatggttaaaatatacctagttctaaatatgtgctggcagctttctaaatattttacatatattaactaatttagtctcagaataagctcatgaggtagaaactagtattaccatccccttaatggttgaaaaaactagggcaaagataatttgcttaaggtcaaaagtgagtatgcagtggaaccaaaatttggttccagtaggtatggttctagaccctattctcttgatcaacagtactcaaactgtagtcctggaccagcagcacctccatcccctaggaacttgttagaaacgcaaactctgaagccccaccccagacctgctgaatcagagactctggggtttgggccaggaataagatctaaccaatctaatttctctaattttttcttgggatcctcttttgctgtgagatcctgctggctgaggttacgtattattggttttctattgctgctttaacaaatcaccacaaacttagtggcttaaaacaatacagattgcagttctagagatcataagtcagctatgggtcttacagggctaaagtcaaattatgggcagggctgtgttcttttctggaggatttagggaagaattggattccaagctcattcagatgttggcagaacttagtgccttgctgttgcagaactgaggtccccctttcattgctggctgtcttgcaggggctgcccttaattattgaaggcctccctgtggttctttcacacagcctcctacatctcagaacaaggaacaatgcatcaaatctttctgatgctgccatctttctgattcagcgagggaagtttatctctcttaaggactcatgtgctttgattggatccacctaagtgaaccagcatgctctccctatcataaggttcacacccttaatcatatctgcaaagtcctttttactttgaataaggtcacatatttacggtgaataaggtcacgtattcacagtttctgggattagggtgtgaatatatttgggggttccattattctgtctaccataaattactcgcttaatattttctatgcttccacaaaaaagggtgtgtgtgtgtggtgctctacatgttttcttctttttagtaaaagagggatcttaccattttgttttacaactggctttttgttcacttaacagcatgtaataggcatctttccaaatattacacatagttctgcctcattcctttgaagggctgcccagtggtccaggagatggttgcatgttacatcatttctttaacctactctcattggtggatatttcagctgtttttatttttcatctctttaaatacagagacagtgaccatcattgtacctatgtctgtgcatttctatacctttgtcttcctatcgtctgttttccaaacagcagccagtgcatgatcattttaaagcataagcctacttggtacctttcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtacccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttcatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatcccggaggaatcgccacactgccttccacaatggttgaactagtttacagtcccaccaacagtgtaaaagtgttcctatttctccacagcctctccagcaccggttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagatatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcacgtttgtcaaagatcagatagttgtagatatgcggcgttctttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgatctgtaaattaccttgggcagtatggccattttcacgatattgattcttcctacccatgagcatggaatgttcttccatttgtttgtatcctcttttatttcgttgagcagtggtttgtggttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtatattgattttgtatcctgagactttgctgaagttgcttatcagcttaaggagattttgggctgagacgatggggttttctagatatacaatcatgtcgtctgcaaacagggacaatttgacttcctattttcctaattgaataccctttatttccttctcctgcctgattgccctggccagaacttccaacactatgttgaataggagtggtgaaagagggcatctctgtcttgtgccagtgttcaaagggaatgcttccagtttttgcccattcagtatgatattggctgtgggtttgtcatggatagctcttattattttgaaatacgtcccatcaatacctaatttattgagagtttttagcatgaagggctgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagatttttgatgtgctgctggattcgttttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatggtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtgttgggagagtgtatgtgttgaggaatttatccatttcttctagattttctagtttatttgcatagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaatgttttgaagggttttttgtgtctctatttccttcagttctgctctgattttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttatcatttctgttcttttacatttgctgaggagagctttacttccaactatgtggtcaattttggaataggtgtggtgtggtgctgaaaaaaatgtatattctgttgatttggggtggagagttctgtagatgtctattaggtcctcttggtgcagagctgagttcaattcctggatatccttgttaaccttctgtcttgttgatctgtctaatgttgacagtggggtgtgaaaatctcccattattattgtgtgggagtctaagtctctttgtaggtctctaaggacttgctttatgaatctgagtgctcctgtattaggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaatttgccagtctatgtcttttaattggagcgtttagtccatttacatttaaagttaatattgttatgtgtgaatttgatcctgccattatgatgttagctggtgattttgctcgttagttgatgcggtttcttcctagtctcgatggtctttacattttggcatgattttgcagcggctggtagcggttgttcctttccatgtttagtgcttccttcaggagctcttgtaaggcaggcctggtggtgagaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatattttttggaggctttgctcatttctttttattcttttttctctaaacttcccttctcacttcatttcattcatttcatcttccattgctgataccctttcttccagttgatcgaatcagctactgaagcttctgcattcttcacgtagttctcgagccttggttttcagctccatcagctcctttaagcacttctctgtattggttattctagtgatatattcttctaaatttttttcaaagttttcaacttctttgcctttggtttgaatgtcctctcgtagctcagagtaatttgatcgtctgaagccttcttctctcagctcgtcaaagtcattctccatccagctttgttctgttgctggtgaggaacttcgttcctttggaggaggagaggcgctctgcgttttagagtttccagtttttctgttctgttttttctccatctttgtggttttatctacttttggtctttgatgatgatgatgtacagatgggtttttggtgtggatgtcgtttctgtttgttagttttccttctaacagagaggaccctcagctgcaggtctgttggaataccctgccgtgtgaggtgtcagtgtgcccctgctggggggtgcctcccagttaggctgctcgggggtcaggggtcagggacccactttaggaggcagtctgcccgttctcagatctcaagctgcgtgctgggagaaccactgctctcttcaaagctgtcagacagggacatttaagtctgcagaggttactgctgtctttttgtttgtctgtgccctgcccccagagatggagcctacagaggcaggcaggcctccttgagctgtggtgggctccacccagttcgagcttcccagctgctttgtttacctaatcaagcctgggcaatggcgggcgcccctcccccagcctcgctgccgccttgcagtttgatctcagactgctgtgctagcaatgagcgacgctccgtgggcgtaggaccctccgagccaggtgcgggatataatctcgtggtgtgccgttttttaagcctgtcggaaaagcgcagtattcaggtgggagtgacccgattttccaggtgccgtccgtcacccctttctttgactcagaaagggaactccctgaccccttgcgcttcccaagtgaggcaatgcctcgccccgcttcagctcgcgcacagtgcgcgcacccactgacctgcgcccactgtctggcactccctagtgagatgaacctggtacctcagatggaaatgcagaaatcaaccgtcttctgcgttgctcacgctgggagctgtagaccagaactgttcctattcggccatcttggctcggaattcctattcggtacatttcaatgtcttcccatctttgttaggtagagtctaacttccttaccatggtctacagtggccttcagaaaatggctacctgccacctccatgacgatcatgtttcccattgctcactccattccagccacactgactttttcatgatcccttgaacatgccaagcccctttctgcctcagaacctttgcattttccattgcctccattgggaaggctgttgccccagagctctatgcggctcaccttctgacatgcttcatgcctttctgacatgttatcttatcagagaaaagttccctggctgtttacccaagaaatagtggcattttccttttactcccatcactcttgtcccctcaccctgttttctcttttattttgttatgcattctttgatacatatgaaatgtatgaacaataatgcatgtcatgcatatttatgttatgaataattatgaacgaagcaatgaagtgaacacaactgttctgtagtttccttcagagcactgatgactacctgatgctgtttttatagtatcactgcctactgtgacataacaaccccatgaggccttaatactgagttatttaccactgtctcttcagtgtttagctcagtgtctagcacatagtgagtgttcaataattgttaagtgaataaatttgtgaagatagatgactagccatgtaatttctgagacaaaagaatttcaaagtacccttcgaaaggtatggtactatacaatcccaccgacagtatattgtttcttatttggtgttttttttaatgtgggataccttttggaaacatgcaggttgttaattataaataagaatgaatcacagaactctggcaggcaataaaagttactctttttctcttgcaggggatggtgagggaaacttattagacaatgaaggagtttacctccagcttgctttccacaatttgggaataagagggcttctctcccaccatgctttttggttggaagagaaggtagagagtaaggcaaaagggtggagtaaatgttcacaccctaatctctggaactgaaataaaaggattagagattaaatatgatcagaaaaaatgttctcttttgatgaagtcttctcagactagtctgtgtactatagtaacctccatctcatttactttttggtttgtaagttgtattaaagcttcatttacatacaataaaattcatacattaagtgtacagattggtgattttattctctttatatttcactaagtttttcatattatttttacctccaaagttatacctaatcatagctttttatttttgataaatgttgtggagaaatttattctcacaaaataaaagctaaaaaatccaatgagaccaggttttaaagatgtacagtgtgaaaattctgaggttgtatagccttctccctatcagtattctctgtaatctttctagcatcacaaaatatccattgtcccatctgatttctatttttccctgtttgttttttgataattatttaatccatttcttgtgcttattgtatacatccctggttctctttttttgagggagagactaatttacccatttatctggtgattttttgacaataaaaatattattcaaattttgatgtgaagaaaaattattgaatgtaaaaaatggcacacactgatagtattttaaatgctgtgtgaccctgagtgacttctttggataacgaggtagaggattgtttcctaccgaaaggacaccctgtatttgatctttaacaattgcactttagtgggcagagcttgatcaaggcaagatgattagactaggagataaaagacctggcctagtcaccaccagctagctcctggattcacagccgaattggaaagtcaggatacatgacacataatggcaatacaaagcaacaatggagacctttctagaaagttgtgaggaatgttcacatgagggagatgaattccagctgctggcatcaaggaaagttccattgagagggtagcctctggaacttggtgattcttggaattcgactttggagatggagaaacaaatagagaaaataatgtgagaaaacacagatgccagaaagtatggggtatatatagggagcactggacatttttttttggaacatgagttgtattggatgcaaaacgtgagttgaagctgaaaaaataatttggacaaaatcttggaatggacaaatgtccccctttaaaactctagtctcacctgatcatacactctccttgccttgactctcctttgtttagttgaattgtattgttctcttcaaaactaacttggctaaataaagagaagccaatacattgtgaaaatacaaatgaccacatgcaaagatgtccaacattgttagccttagggaaacacaaatgaaagccacagtgagacattgctacacatttatcagaatggctaaaataaaacataataacaataccaaatgctggtgaggatgcagagaaattgggtcacttctacattattggtagaatgtaaaatggtatagctgcactggaaaacattttagtaatttcttaagaaacaaaacatgcaactacaacgtaactcagcaataactcagcacttctgggcagttatcccagagcaatgaaaacttacattcacacagaaatctatacgacaatgtttgtagcccaaaattggggaaaaacaccaagatgtccttcaatgggtaaatggttaaacaatctgtagcacatccatatcataccagtgacaaaaaggaatacactattgatacatgcaacaacttggatgaatctcaagggcattatgcagagtgaaaaagccaatctcaagtggttacataatggatgatttaattatgtatctaatgtttttgaagggagaaattttgagaaatggagaaaagattggtaattgccaggggctacagatagggataaaaatgtgggagcaaagtgagtgaggctgcaatatgagggatcttgtggtgatggagatgttcagtatcttgactgtgatggtggtgtcacacacacacacgtgcacatacacacacacacaaacagagaaatgagtacaggtaaaactagggaactctgaataagatcagtggattatatcaatatcaatatcttggttgtgatattatgcttttgcaaaatgttaccatcgggggaaacttgataaagtgtacacggaattctctgcattattttttgcagctgcaaagggatctacaataatctcaatgaaaattgcagttaaaaaaatcccaatggcataaggttctcaaacccaattttctaaattacgtatgttgttaactaacatcaatccttaaacagcaagcatgtcttcagttccttggcctggcctctaccccactaattaatcttcatgtggtaagagtcatcttattttctatctttcaaagactggtcaatgtattttctttttcaacgcgtgcaaaagtccaggctctaacattgccacctacttaggattctcgtattgagctctggtttctaatttgtgagacctgcctcattcacagccaattgaaacaatgaatgtctgtaacttccaggtgagatctgatccccagatgtggcagtcatgaaagttcactcctcagatcacccttcaagaaagaacctgctgttcatatgcaggggatgcagtgagttggcatcctccaggtgcagcaccttcaggatctgcctcagagtgtgggggaaggccacacttactgagtggtatttagccaatgattgggcatgatgtggttgctagtgcctgtcctttaggggatgcctctaatggacaatctttgctccagagcttctcactgggttttccaagactttctcagatatgcagtttgatgtgaagctcttcctgctaaatcttgatttcctcctcctttcctttcacaggtatcatatctgtaaggcaatctgaaggccctttctgctcatctgctttattcccttttcagctttcacaggcattactccccaatgaatttcttgtgttcctaactttttgttaaaagctgtttcttggatacccaaaatgacatacaataaaagtagcttaaaaacctctctggttataggcccacagtatagcaattctttgtctgaacagaatccgtgacatccttactaaaaaattatgaacattcaataacaggagggttgttctctcttgttggtggttacagtcagtatagttcaggtgttcttgctctatcataaaattgggtttgggtggtaggtggctgaaatgaaatgctgataaagcaaagtccatgggattgaagagtaaggaggaactgaagtgggtgcatttattgggacaccaatgtggaagtcaatgttccagtgtcttctactaacatctgtcttctactagaagaagattcccagctgttacatctgacacctatttattagattggttaaattttatgtttcttgaagttaagtggtggtctccttaaggccaagggtaacagctcacacaaagacttggtcaagctccccttcactgctctaaagaaatatctagatttaagctagtaatctcatggctatctgtaaaatctatgatatcttaaagttattgcaagaatattacaggcttttgattttaaaaatcaaaaggggtttctgagcatcatatacatttttaatcacaaagtcatgttccatattttgaatgaaccacccctacgcacacacttccccttctctcttgggcaaaggctccatttctgttacccctcttgacttgtcagattttctggcatgtcattctcatcctactgaacacaactggaatttgtgttggcagattttctgcgcatgctgggtcagttagagaaggaaaattattgtatttgattaagatgttttcatttttgttctgttctgaaggcaaattaggactatccgaattagtttattcttttagtgttgattgtcttaacttttgctgccaatctggattttgaattcatatttttaatcattcaaggattatttttggataaaccgatgtggaattcaattttactttccaaattacatagctccagaaggatctagagattagaaggctgagcaacctgtttgttattagcaatatgtcgtgctctacacttttactttaagtatgatgtaaaaaagcatcaggaatctttaagccacaggggtcttgacctggcaattaactctcagacctaaattattcatcaatttgtttgttctttgaacaaagttttgagtacctgctgcatgccaggcgttattccggtgctggagttgccatggtgagtaagaaaacatctctctcttaattgaagcttatacattagtggaacaagcaaactattggattcatgatgttaggtattggtaagtgtgattaataaaaatagagcagggtaaagaactagcaagatttcaggcattctgttttagaaattacagtcagaacagttttctctgaagatgtgtcatttgaacagagacctgaatgaagtaagagtaagccatgaagagcagcaaaggcaaaggtcctgcggtaggggttgcttggtatgtctgaaatatagcaagaaggctgctgtgtttggatcatagtgagttagcagaagttagcagaagaaggatactagagggttccaggccatggtaaggataagaattgtttctaagcatggcacttctgtcatctttatcaatcagtcatcacattcatcagcattgtcaattagtgtctgacctcctcaccctgaattgccttcaaattacttaacacacattttctaggcacctgttttgacctaggcactgcttattttgcttggctgtggacaaaggaaaaataacacctagtctttgccctctgattgctaacagtccaatgagcgaatgcagacatatgtgatatcaccatttgccttttgttaggactacggatcttgagaaaagtatgagacactatgggaatgctttctgtgaattttctcattgtaaaggaaggattgcagcattaataccccacaataataatttcttatattctagagtgtttaatgtttacagagtatcttacattacagtcatgatcctgaccaaaatgagataacttttataaacacccaacacagtgcctgacacttagaagacatgtagtacatgataattcactttttcttcacaaccatccaaaggttgctaaggttgctatgtatcctcagtgatgaagtaatgagttcattgctaaataaccaatacatgggaaatcaggttcttgttttacaagaacagagaattgctcagattacttcacactagggagggattgatgttggggttatcaagatttgtgtcgaaatgagcaggaatctcagtgtaggcgcctaaaacagccatgtagttggactttgtgaggactggaaggaggtttagggaaactaaaaattttcaaacttcaacacagctctagtgatttatgacttggcaactttttgcaagagaattccagggtgccaggagaggggaaaggttgagcaatattgctgcctggctaagtgctttcccaaacgacatcttcagcttccagggacaccacaaggagttccaggacaggagtttatgattatatttgatgaatgcttcctattttgattgggaagttttccagtttacaagattgactggaattgtagacatgtgggtactgccagtggaaggagaaatcaaggaaactactcaaatagcatggcttttttggtttgcatgtcagcttagcactgaggaacttggttcagataagtttgaattacatcgttcagcatatgtaatttgatacctgagtggaaatttgcatcaattcccaagggctgcagctgagagcattgccaggaggaattctttaaggctgaaaatatatctttaaataggcattgtgcctccagttccgctctagaatcacccattgctacaatgcctggaaaatcacagggagtccaggggacctgggagagtggctgagcacagcttttagtagttaattcctctatattcaatttttctctgagtacctacaagaccaactgattcagagttctgtgaagaagaggacttctattgtatctgtagccacctttccctcatggaaagtccttttttttcccctttcacatttactaagtacttcccatgaaccagctgctgcttttccttaatccttaatccacaaacaaatgggttgatttgtcatcctaaagctcagctcgattttatatcatttgcctgctcaaaaatcttagtgttcctctccatagcacctaacagaaagcttgatttctgccctgggttcttgtcttgatcatggcggttacctgtgacctcttcttccctcgagtttctgtgattctgggatatggctcccagcttagcttctgatattgatttttttttgttcactgctgtatcccttggtcaatagaacagcgtataatccatagtagacactcagtaaatactggttgagtggatggagacagaaaatgaaaagaaattgtttgcctaaattaccaagtcacagctccctggaaggatctagttttatctgtggtcctttgtcactattcataagaaaaaatgctcaatttcacataaataagaacatttcaaactaaaactgcactgagatatcattttcaaccctcagattgaaaagggcgtaaatgcttgatagcatactgtgttggcagaggcttgagaaagcaggcattgtcacatgtggggatgtgaactaatgtactgtcagagggcaatttgacagtatctaacaaaatgaaaattatatgcatcctttgatccagtggttctatctaggaactttaaaaaataaatatgttattctgttaccctagtcctttcaaactctcctgaacaatggtttgattcttttctcctggaatgccaacacctcctttcctgcctcactctcagctgaaaatgatcttgctttctgcttcactgagaaaacagaggcaatcaaagggaatctccacatactatcaacatcttttccacctacctgcatctacacccaggacctctgttctgatcagcatataaacaagctgtaatttcttcaatcttaaagaaaaattctgatgtatcataccagctttgctgtatttttctttccctcgaaaaataattccccgtactagctgtcttcagtccttttttttcccaattcctcttcaactatttcccatcaggccttctttctcaccactctactcaactattcttgtcaaagttaccagtcccctccaggtaaccagattacaagaatgtttcctagtccttttttatacttgacctatctgctttattcgatacagttggttcctccctcttccttgaaaaactttctacacttggcttctaggaaagcccacttccctgattctcctccaaccatttcgactattccttctcagaatcctttcctgattcctcctcatcttcctgacttctaaacgttggaatgtcctagaacttgatgtcttctatatttatatgcactccctaggtagtctcaaccagttgcatgactttcaatagcgtatatatgttgatgacttctaaattatatttagttggtacctctgccataaactctagacttataaatccaactgcctattagacatgtctattttaacgtctaacatgcagtcagttatgttataactcttgctttgaaaatttgaatttgtttcaacacaattgatatattagggaacaatttgaccataatgcacatttcacgtatgcattattttgttcaagaaaaacactaggggaacacagaaaactccacctgtagtgagcagtgtaggaatgcacaaaatgcacatgtgtgcacaactcaaacatctgtcagctacctcagtttaccatgtgtgttaggagctacacccatccacatctgaattatggttaagtcctcaaaagcaattacaacaaaaataaaaattgacaagtgagatataattaaagagcttctgcacagcaaaagaaactatcaacagagtaaagagacaacctatagaatgggagaaaatatttgcaaactatgtatccaacaaaggtctaatattcagaatctaaagaatttaaacaaattcacaagcaaaacacaaccccaataaaaatgggcaaagaacataatcaaacacttctcaaaagaagacatacacgtggccaacaaatatatgaaaaatgctcattatcattaatcattagagaaatgcaaatcaaaaccataatgagataccatctcacaccagtcagaataactattacttaaaagtcagaaaacatcagatgctggtgaggttgtttatacactcctggtggagatgtgaataattcagccactgcggacagcagtctggagattgccaaaagggcttaaaacagaactaccatttgacccagcaatctcactattgggtatatgtgatggttaatattaggtgtcaatttgattgaattgagggattcctatataactggtaaagtgttgtttctgggtgtgtttgtgagggtgttgccggaggagattgacattcgagctggtggactgggagtgaagacccaccctcaatgtggcaccatgcaattggctgccagcacagctaaaacaaagcaggtggaagaaagggggatagcttgcttgctgagtcttctggctctctttttttccccataccagatgcttgcttccactccttatgcccttgcacattggactccaggttcttcagactttggactctgggacttccagcaaagtggctttccagaaacttttgggccttttgctgcactattggcttccctggttttgagatttttggacttagactgagccacttttggcttctctctttccccagcgtacagaatgcctattgtaggaatttgccttgtagtagtatgagcaaattctctaataaactcctttatatatagacatctatcctgttggttctgtctctctggagaacgctaatacatacccaaaggaaaataaatttttctaccaaaaagacacttgcactcatatcttcaccacagtgctattcacaatagcaaagacataggatcaatctagatgcccatccatgctggacagaataaagaaaatgtggtacatatacaccatagaatactatgcagccaaagaaaagaaggaaatcatgttcatttcagcgacatggatgcagctggagtccattatcctaagcaaattaagcaggaacggaaaaccaatacttcatagtcccacttacaagtgggggctaaacagtgaatacacatggaaacaaagatgggaacaatagatattggggactgcttgaggagggatggtggggcgagaggcatgggttggaaggctacctatcacgtactatgttcactaccttggtgatggagtcattcattcactaagcctcagtgacatgcaatttactcatgtaacaaacctgcacatgtacccactgaacctaaaatttaaatattaaaaaagtcttactgtaaatttactgtactgaagacagtatggtgtacaaagatggacatatagataaatggaatggaatagataatccataaagagatgtgattatgtgtttcacccaagagagatgcaaacatatgtccacagaaagacctcatgaatgttcacgtctggtttattctaaatagacaaatatgataataatccaaatgcacatcagctggtgaatgaatggtcatattgtggtatatctaaaacaatgagatacttctaagaaataaatatgaacagactaatgatatgtgcaacaacatggatgaatcaagaaagcattacgctaagttaaaccacatacaaaagggtatatactatatgattcaatttatgtaattttcaggaaatgacaaatctatagaggcagaaaataggttagcatttgttagaggccgggagcttggggagaggattgagtatgaaagtcatgagaaaactttttgggggtgatggaaacattctacatcttaattatgctggtggtaatgtatatctgtttgtatatatttgtcaaaaatcacatcattgtacacttataaagggtgaattttatgtaaattgtaccataccacaataaacttaaaaaataaaaataaaataaatattgaggtaggtaatctatagttggtgtggttgctccatgatagtatcatcaacccaggctcaaacttttaatccaactttttctttcatcattatggctgcaagttgcctgctacatttataggcattatgcctgcattcctagcaggaagaagaactaggatagcaggaagatgtggtgtcttcattagaaaaatgaaaagctttcccagaaaacttcagcttttgtttcattagctagaataaaaccacatggccaacagttactgcaagtgagcttgatgaagtgagttttttacctggacacattgtcacctccaacaaaatatgggttctgctagggaagagaatcttctactctatctttaaaaaaatagtcaatatagtttactgtaagaaatttagaaatataggtgggtcaaaagagaagaaaaaatgaacattattcctaatcctatagtccaactatagtagtcaaattctgttagcttttttacaaaagatcttgtacattttttaagtatatttttaaagtaatagtgccttgtacctaactgtagcttattaagttttcattgaatgaatgttgagtaggttttaatcagggagagaagaagggaatggtgaaaagaggaaagagtatgagcatgtcacacctttgaagcagtatatagtaaagagtataattagacaaaactgtatccacaaatctctttgagacaggcttttttctatcttggacctctgggctgctgtggaacaagactgtgaagatttttaaaatctctgttgtttatgacaggggtctagaggtatgccattaagatccttagaatggtcttttgttggtaccttgagttttctataaggaacttatagattgatttataagcacagatctttctgaggtcttaactaaggatcttactgaaatcctgtcatctggccaaggatttaatctttcctcctgatataatttggctctttttccctacccaaatctcatcttgaattgtaatcctcatgtgtgaaaggagggacctggtgggaggtgattggatcatggtggcagtttctcctatgctgttctcatgacagtgagggagttctatcgagatctgatggtttaaaagtggcagtttcccctaatctctctctcctgctgccatgtaagatgtaccttgcttcccctttgccttctaccatgattgtaagtttcctgaggcctccccagccatgcagaactgtgagtcaattaaacctcctttctttataaattactcattctcaggtagtatctctgtagcaatatgagaacagactaatacagagaattggtatcagcagagtggggtactcctataaagataacctgaaaatgtgaaagtgactgtggaactgggtaagaggcagaggttggaacagtttggagggctcagaagaagacataaaaatgtggggaagtttggaacttcctagagagttgttgaatggttttgaccaaaatgctgatagtgatatggacaatgaagtccaggctgaggtggtctcagatagagatgaggaacttattgggaactggagcaaaggtcactcttgctatttttttagcaaagagactggtggcattttgcccctgccctagagatctgtggaactttgaacttgagagagatgatttagggtatctggcagaagaaatttctaagcagcaaagcattcaagttatgacctggctgattctgaaagcattcagtcatatgcattcacaaagagattatcagaaactggaacttttatctaaaagggaagcagagcatcaaagtttggaaaatttgcagcctgatcatgtggtagataagaaaaacccattttctgggcagaaattcaagctggctgtagaaatttgcctaattaatgaggagctgaatgttagtcaagacaatgggaaaaatgcctccagggcatttcagagaccttagtggcagcccttcccatcacaggcccagaggcctaggagggaaaaatggttttgtgggctgggccctgggccctggtgctctgtacagcctcgggacaggttgccctgtgtcccagctgctccaggtccatccatggctaaaaggggcaaaagtatagcttgggccattgcttcagagggtgcaagccccaagccttggtggctttcatgtggtattgggcctgcgggtgcacagaggtcaagagttgaggcttggcagcatccacctagatttcagaggatgtatagaaatgcctagatgtccaggcagaagtctgcaggggtggagcactcatggagaacctctactgggacaatgcagagggaaaatgtgagattggagcccccacacagagtccccattggggcactgcctagtggagctgtgagaagagggccaccatcctccagatcccagaatggtagatccactaacaactttttgccatgagcctggaaaagccacagtcgctgaatacccatctatgaaagcagccacaggggctgaaccctgcagagccacagggacagagctgcccaaggctgtaggagcccaccccttgcatcggcgtgccctggatgtgagacatagagtcaaaagagattatgttggagctttaatgagttcctttccaggttttggacttgcatggggcctgtggcccctttgtttggccaatttctcccaattgggatgggaacatttacccattacctgtacccccattgtatcttggaagtaactaacttctttttgattttacaggctcataggcagaaggaacttgccttgtctcagatgagactttggacttggacttttgggttaatgttggaatgagttaagattttggaggactgtttggaaggcatgatggtgttttgaaatgtgagaagggcatgagatttgagaggggccaggggagaatgatgtggtttggctgtgtctccaccaaaatctcatcttgaattataatcctcatgtatttagcctgggacctggtgggaggtgactgggtcatgggaatggtttcctccatgctgttcttgtgatactgagggaattctcatgagatctgatggtttaaaagtggcagtttcccctggtctctctctctgtctcctgccaccatgtaagcggtgccttgcttcccctttgccttctaccatgattgtaagtttcctaaggcctccccagccatgcagaactgtgagtcaattaaacctcctttctttataaatgacccagtctcaggtagtatctttatagcagtgtgagaatgaactaatacccttccttaaacagttatttctataaccagcataccctggctgctttatgtttcttccacatctgcttgaaaactgaacagttcatcctttagttgatcactctagatgaagaggaagaaactagttgctattttttatatcctgcctggaaatcttcccagccatattaatgagttgattgggccccagatttattttcaatgatgcccaggtgagtgttggcaagggcccccttatctttcctccaataatgcttttctcactgttttccaagccatggtcttctcaaggcccttctagcttttcataacagttttcctgagtctcttccaaccttaactaatagtctatttaatgtccttttagtttctgcctgctgtctggtcccaatgctgaagccacatgtgttagtttttggtgagacatcacttcactttaggtcctaagttcctttttagttttctattgctgtgtgagaaaccacttcataatttaatattttaccatttaaaatacattaggatgaccgctatttaaaaaaaaaaacaaaaacagaaaataacaagtgttggcaaggatgtggaaaaattggaaaccttgtgagctgctggtttgaacgtcaaatggcacagctgctctggaaaacagtaaagcagttcttaaaaaataaaaatagaattatcatgtgatccagcagtttcggttctgggtgcatattcaaaaaacttgaaagcaggatcttgaagatatatatatgtatatatatacacttatgtttatagcagcattattaaaaatggcaaagaggtgcaggctacccaagtatccatcaacagataaatgaataaacaaaacatggtttatccacacaatggactattatatcatccttataaaggatgataattctggcatatgttgcaacttgaatgaaatttgaagatgttatgctcagtgaaataatccagtcacaaaaagacaaatattgtatgatttcacttatatgagttacctagcatagcaaaattcatgtaaacagaaggtagaatggtggttgctgcaggggagagaaaagaatatcgttcaaagggtatagaatttcacttttgcaagatgagaacagttctggagattggttgcatgccaatgtaaatgtacttaacaccactgaactctacacttaaaaatagttaagatgctacgttctatgttatgtgtattttgccacaactgaaataaacacaggatgccaaaacaaagtaatatttttttaaaaagcaatttataaccttctcttacaaatctgtgagttgaccagattcagatttgtggttcctttttaaggtatctttggcagttgtagttagttgttcagctggggctacagtcttttgaagactcaactggagtaaatgtacaatattgctcactcatattactggtagttgatactggccattcattgagagttcagctggggtagttgactgaagtgcacacatatggtctccacatggcttgggattcccataatataataactagtttcaagagggagcttcctgagagacagaatcacaagtgtgcttttctaagggagcaaggttgaagctgcaagacttcttctgacctggctaagaagtcatgcagtgtcacttctacttctattggtggctaatgaataacatattcacccaagattcaagggatggagcctatacaataccaccaataccaaaaggcacgcatcattgggggctcatttttagagactagctaccacagtattactgcaatgtaaatttcaagtttggcagtagcagaagatgtaaccgcaaaagtaggtaggaataagttggtgaagttctttgaataataatggaagctctagtggattagaatgttgttttcaactattctagtttctctctatattagtgtttttcatccatgtgactttaccgtgccacttagtgggtgcagtttacttccctgccccaatgactttcagtttagtcatgtgatgagtggagagttttggccaatgtaatgtgagcaagtaagaaatatgccatgtcccattagaggttttaaatgtgcccacacagtttgctttggccttttgtgctcttaccaccatctatgagaagaacatatccccagatagctgctgtttcttctgcctgggttgtagaatgagactgctgtttcttctgcctgggtcacagaatgagactacatggagcacatttgaacctgagcccaggtgaaccctatcaaatcacagctggcctgaagaccctgagcaacaaatgttgagattgatgcggggggtttgtttgttcctgcagcaaaagaacacagtgactaacatttatgagtacttttagtatgacagacattttgccaagcatcgtaaactgatgacctcatataaccaatcatgtgtgtcatactaatgaatttagatttcattttataagtggctagactctttgagggaatttaagagagagaggagattgtcatattgaaacttatatgttagtaagatctttctggcagtggcataaagggcagacttgggagtaagtctgttaagaggttgctgaagaagaatacatgagatattacgagtgtctagactaggatagtgatagtggaatagagagagatatgtggattttagaactgtttggaagaaatatttatttattttgaaaatatttgatttatttgtagcaggcatatgccaagtgctcagggaaactgcaaatagttcagtatggagcctggtgtgggaatagggagtgttgggagatgaatctctagtgacaagcagtatcttgatcatgcgatattctatgtcatgttgaggtgtttagcctttatatcaagggcattgggcaaccagttaattgttttgttcaaattttgcaccttaggggagatagaaagggaaaaataaaggcaaggggaacaattgtaggactgttgaagtaagttcacagatacttattgaactccagctatgttccaagtgttgtactaggcattggggatataatgttgaataaaaagataaaaatctctgccctcttggaacttagccttttaggggtgggaaagatattaaatatgtagcagtaaatagttagacatgttctaagtgtttcaaaggaaaagcacatgattctgcggaagccagaggaagggacctgccattgttagaggtgagggaaataaatgtttatctaaaggatgtgaagtttaaacgatgaacttatggaaggataggggttaaccaagtgaaaagagttggggttagtggataaattatattctggaagaggaaatagaataagctgaggcctgagttggcaaaggaaatagtatgtccaatgagatttgggtagaacaacatatgacagaactggagaagtaggcagtgttcagagtgtgtagaccccagtaagccacacgaatagaatttgatatttgtcataaaaggaaaaggagctgatgagaggttttaaacagaggagtgatatcgttctgatttacattgtaaaacatattactctttgctgtgcagagaattaattaaagggccaagggtgaaaagcagggaggccgattagtatgccttgaaataatcctggcaaaagatgatggtaaaagtccagggcatgttacactgaggtgcacttgggacattcaaatgaagatgtcaagtaggcaagttaatgtatggatctggagcatagaatcaggaagtagtaggaaaacaaagaacagtagcttcagacagaaaacagtgagccctaagtcagttaagcttgacttgtggtgcaaagtacattgctgttgctttttgggatggcgtttgggcttgtgcagtaataatggagccagaaagaagagggaagagttaaaagacatttagaaggtataatgaatgggcttggcttatggtggaacaatttacccagattgggaagaccatagatgaagcatatttagaaggtgggagaatgatgatttccaatcattctcagtaaactatcgcaagaacaaaaaaccaaacaccacatattctcactcataggtgggaattgaacaatgagaacacatggacacaggaaggggaacatcacgctctggggactgttgtggggtggggggagggatagcattaggagatatacctaatgctaaatgacgagttaatgggtgcagcacaccagcatggcacatgtatacatatgtaactaacctgcacattgtgcacatgtaccctaaaacttaaagtataataataaaaaaaatgttgtgtaatcatcacctctgtgtagttccaaaacattttcatcacccctaaatgaaatttcatacatattagtccttcttcatttaccccttcactagcccctggcaaccactattctgcttgctatctcagtagatttaccctttgtaaatgtttcatacgcatggaatcatacagtatgtgcttttttgtgtctggtttctttaaattagcatgttttagaggttaatccacagcatgtatcagtacttcattcctttttatggctgaatagtatgctattgtttgtgtacaccacattttgtttatccattcatctgttgacaggcattcgggttgtttccacctttttttttctattgtgaatagtgctgctattaacgtttgtgtctgtgtttttttttttttctttttttgagtacctgttttcaagtatttcaggtatatacctagtaatgaaattgctgggtcacagggtaactgaggaactgccaaactgctttcttaattaacagaaccattttacatcctcacaagcaatgtacaggggtttcaatttctccacatccttgtcaacacttgatactgtctgacattttgattatgagcatcctagtggatgtgaggtgtgtttttaatttgtgtttttccagtgactaataacattgaatgtacttccatgtgcttgctggctgtttgaatatctttagagcaatatctgttcaaataatctgctcaatttttagttaggttgtttgtcattttgttgtcaatttgtaaaatttccttgtatattttgagtaataggcccttgttatatatatgattcgcaattagtttctcccattgtgtgggttgtcttctcactttcttgatggtgtatttgaaagagaaaaatttttaattttgatgtagtcaaatttatccatttttaattttgaaatccaatgtgtctatttttattttgtagctcatgcttttggtttcatataagaaacccattgccaaatccaaggtcatgaagatttaccctatattttattttagcagttttatggttttagcttttatatttagattattgacccattttgggtcactgtttgcctatggtatgataaatgggcccaacttaattcttttgcgtatggatacccagttgttccagcaccatttttgagactattattttcatattgaatgatatttgtgccattcgaaatcaatggattaaaatcaatttcaaaatcaattgaacctaggtatataaatgatatatgtacatatacagctatacatacagatatatatcatatatatctatatctatatctatatctatatatctatatatctatctatctatctatatatatatatatatatatatatatatatatatatatatatgtctgtcatcatgctagtaccacactattttgattggtgtagtaaggtttgaaagaaggaagtgtaagtcctcaaactttgtttttcttttcccctattattctggctattcagagtccaatacaattccatatgaattttaggatcagtttttcatttttgcaaaaaaagaagtcctttaagattttcatagggattcaattgaatatgtagatttctttgagtaatactggtgtcttaacaatattgaattttccaatccatgaacatggcacgcctttccccatcttatttaatttaaaaatttttttttctttaatttatttcggcaatattttataattttcaacacatgccttgcacttacttggttaaatcattaaaacatttatttaatttttaatgatattataaatgaaattatcttcctaagtttctttttgcattgttcatcgctgatgtagaaaagtgtaataaatttttgtcttttaatcttatattctgcaacttgaattcatttattaattaatagttttctgggggattctttaggattttctacatggcatctctaaaaagagatgattttccctcttcatttccagtttggatgccttttattgcctagttgttgttcatagaacttccactacagtgttgcattgcagcagtgaaagtgggtatctttgttttgtcctttatcttagggggaagtttacacttttttgccactgagtatattgttagctttggagttttcatacatgtcctttatcctgttgagtcagtgctcttctactcctgatttgttgattattttctttatttttattttactttgagttccgggatacctgtgcagaacgtgcaggtttgttacatagatatacctgtgccatggtggtttgttgcaccttttgacccatcatctaggttccctcccctcgacaccccaccccccaaacaggccttggtatgtgttgttcccctccctgtgtccatttgttgtcattgttcaacttccacttatgagtgagaacatgtggtatttggttttctgttcttgtgttagtttgctgaggatgatggcttccagcttcatccatgtctctctaaaggacatgatctcattcctttttatggctgcatagtattccatggtgtatatgtacaacattttctttatccagtctatcattgatgggcatttgggttggttccatgtctttgctattgtaaatagtgctgtaataaatatacatgtgcatgtgtctttgtagtagaatgatttatattcctttaggtatatacccagtcatgcgatttctgggtcaaacggtatttctgtttctaggttcttgaggaatcaccacactgtcttccacaacggttgaactagtttacactcccacccacagggtaaaagtgttcccatttctccacagccttgccagcatctattttttcttgactttttaataattgccattttgactggtgtgaggtggtatctcatggtggttttgatttgcatttcttgaatgatcagtgatgttgggcttttttcatatgtttgttggtaatgtcctccattactgccatattttgtgattagttcatttttttcttgtgaaccattttgattccttccttatttccttttctgtttttttttttaatttttatcttagtagtttgtctgtaactatcaaatttgaatgaatgccaacttaatttcaatagtatacaaaaactctgctcatttacatctccagcctcccatattgtttctgtcacaagccacatctttatacattgtgtgtccatttatatagatttataattattgttttaagcatttgtcttcttaaataatgtggggaaaaagatgagttacaaaccagaatagttatgaaactggcttttaaattaaactatgtagatagctttatgttgctcttcatttctcatatggttttgaataactatctaatgagttactctttccagctttgaagacccgctttagcatttcttgtgggacaggtctacaagttgtaaactccatcaacttttgtttacttgaccaggtctttatttctcttttattttggaaggaaagttttgtcagatatggaattctttgttgacaagtttttcctttcagcactttactgcctctggcctccaagatttctgaagagaaataagctgttaatcttattgaggctcttctgtacatggtgagtcacttctctcttgctgctttcaagattctctgcctttgcttttcaataatttcattgtaatgtgtcttggtgtggatctctttgagtttatgctatctgaaatttgtagaattttcttggatgtgtatatttatcccttttgaaaactttgggaaatttttggccacacttttatcaaatatacttttttgccttctattctttccttctggaattttcattatgcatatattggtatgcttgatgttataggtcttttaggctgtgttcactttcttcattctttttttcttctcctcagactagatgatttccttaatctatctttttagtacactgattctttcttctgtatgctcaaatctgttgttgaacctctctggtaaattttccaatgcagttattgtactttttcagctctaaaattttaatttggttcttttcaataacttctctctcattattgatattctctttggtgagagatcattctcctgattttctttaattctttgtctttgatttccttgagctctttgagcatatttaaggcagctgacttactatcactgtctcgtaagcccaatatgtaagctttctcaggaacagtttctattagtaatttttttctgtaaatgggtcatattttcttgtttctttgcatgctttgtaaatttttttgttaaaaacaggacattttgaatagtataatgtggcaactctggaaatcagattattaccctccctgggcttgctgttgctgcttgctactggctgtttgtttgtttagtgactcttctaaattatttccataaagtctgtattctttgtcatgtgtggccattgaaatctgtattgcattagtttaatggtcagatagtgttttacatggtttctgtaaaagcctgaagccaaaaaaagaaagaaagaaatattaaacaggaaaaaaaatctatttagttagattggctttctgttgtggcactcttactgcttagccaggccttaaccttcacttccggtttgagagaagcctgagggtcactcaaaggtgaaagcttagggttttctcaggcctttcctgagcatatgtttagccctgggcaactgcattgccttctcaattcccacctataagcaagagcttcaaaagtttttattcacttccctccccatatctcctttaccaacttcctccttcccatgatttttcctttgtctatttctcatacctatttcttgctcaagattcctttagccaatgtttgtctttaaacactttctgcaaaaatcacctaggaagccactccaccctgggaatggtgtaaattgagcaaaacaaatgcaaacccttgcgctgatgcttcataatgctacccaactagttgaaagacaatcacagctatttgagaataaaattcctgttgctccctttggcactagcaacctgaaccaggaatgcaggatgtcatcttcatggccactgctgatctgggaagtggaagatgatcggtgggaaattgtaaagtccacaacattctcttactacaacgcagcagcttcctttttcattaaactttctcctggttattgtaaattttgactagttcctagagtcctgcaaagttgattctgacagtttttgctagtttatctgttgcttttatggagggaggggactgtgaattccctattctgccgttttctgtggaatcactatctttgtgggtttttgatgtgtttactaaggcttctttaatccctttttattctctagtggctggcaatttttgctttctatttttattctactcgtgttacttaaaatttttcataagttttataaaaagtgaacacctgtgattataaagcaaacacctgcatagtcatgattcagctcaagaaattaccagcaccttaaggcccactgtgtgtctcttgaaaatcactcccatctaattcctttatggaagaaactgatatccttagtttcataattagaatgaccttgattttattgtagttttactacccatatgtgcatctccacacaatattgtgtaattttgcctgtttgtgaacagtatataaatgcaattcagtgtatatgttttattttgggggaggcttttcttatttcactcaatatgatacttctaagattcatttatgtttggtaaagtgacagttcatatattttgcccattaaaaaaattaggctgtttgcctttttattattgaggtgtacatgcttaatatagtctctatacaattttttgtcagatatatatcttataaatatttctatcagtctgtggcttaccttttaatttccttttttttttcttttctttttttttgagatggagtctcgctctgtcacccaggctagagtgcagtggcgtgatctcagttcactgcaacctctgcctcctgtgttcaagcaattctctgcctcagcctcccgagtagctgggattacaggagcccgccaccacgcccagctagtttttgtatttttactagagatggggtttcaccatcttggccaggcttttcttgaactcctaacctcgtgatccatcctccttggcctcccaaagtgctgggattacagatgtgagccaccgtgcctgttaattttcttaacagtgtctttggaagagccaaagcctctaattttagtgaagacaaatttatcacctttcttttacatgtcatggttattgtgttctatttaaaacaatatttttctattctaaagtcactcaaattttttctttttttttctagaacattaaaagttttagcccttacatttaggtctacaatcaatttcaagttaatacttttgtaaggtgtgtggtaatggtcagtgttctttttttttgcatacagatatcttattgttccagtacaattttttgaaataattgccgtttcattggttctgtataccaattgaccatgtttgaatggttctatatctacatgctttactatgtttcgttgatctatatatctatatttacaccaatactatactgtctttattgtagttttatattatctttaaatttagtagtgtgagtcctacaattcttattttatttttttaaattgttttgactgttttaggtttcttgcatttccacatcaattttagaattagcttgtcaacttttacaaaagtctgcaagagttttcattgacttcatattgaatgtcgatctgtagaaatgaatattaacaataataaaacttccgatctgtcagtacagtatatctttgcattttatttaggacttctttgatttctcccaacaatgctttgtaattctgttttacatctcttgataatctattgtcaatttcttccttaaaattcaatatttcatttgaattttttggatgctgtttggatgtattttattttttggatggtatcctaaatggtaacttctaaatttttaaatttcgatttctgtgtattcataactagtatacagagatgcaatcagttttgtatattaattaacctcatatactctctaaatttttcaaaatacaaatattagttcgagtggcttctttgtggattatctaagattttctacataaatgattatgtcttctgtgaatatatgcagttttattccttcctttccaagcttcatgcttgctttccctgtatctttttttattccactggatagtatttccagtacaatgttgaacaacattgtaccaatgtcaaataacattataccacttttcgtgtcatataagaactgtacaacagtatacagtgcttctatttccctccccaagactttgtgctatttttattgtacattttactccaacatatgttttatgcctcatactatgttgttattacttttgatttatacagttatctttttcctttcttttgactatttagcaaagtaacattgcataagctgtttagtaactaggacacagcttacacagcatgttaaatgcatatacattatcagcagcaaattagaaacagaaaatagcagtattgagttacaagtctcctataattttttaaaagaggaaaaattgtgttgtcgaatctgaagagctagttaagtatagtctgaatcttaagggacatcatctgccatattcttaaattttaatacttacaaatgcctagttttaaggtaataaagcagctggttgtgtctacaacacgttattctatgacaccacatcaaaaaactttcagtaaagaaactcattcctgttttcttagtagcatctagaagactcccaaataccaagaatcttaacttttaaatggtggcgttccagatatgatgccaaaaagcaatgtgataattgagtttcataacagaattaagtgtccaagaaaagaaaaattacccgtcactagctcattatctcactatcagaatttacaaacaaatctttctattttgcaggattccttcttttaatattttaaggaaaatgtgggcatattaaagtaataatatacaaatttacgttctgcattcttcctctaacaatttggccctgtgcctctttgaagaatgaaaaaccctacaaaactaaattttcataatgagaataatagtgtaataaagtccaaaacaaattgtgatgctgttggttttcaaaaagctttaaggcctgagatgagcaacccactgtaacattatgcactaatcaagctgataatgctcttacagtttatctctgtcagctgatttcataaagtagctttgtcaactgtaaacaaagccaattatctttttaagagactaaggaataagtttaaaaagtgttttatatttatctgcatatttaagtttccagggctctttattcttttgtgtatattcaaatttccgtttatcttttcttgttctgcctgaagcaattcctttagcattcattctaatgctggtgtgttgatgatgaattttcttagctgttgtatgtctggacatatttttattttactttcacatttgaaagatatttttactgggtatagaattctagattgatggttgatttttgttgttttactttcaatgcttcaaagatgtttccccactgtgtttgggtttgcattgtttctggtgagaagtctgatttaattttattcattttctgtatcatatatctttttctccacttctggttgctttaaagatttgttctttttattactgttttcataattagattgtagttaatgttttctcatttttcttatgctcaggattcatttggtttgggtttgtaggtttatagttttcatcaaatttataaattttgcccattatttctttaaataatcttactcatgcctcagcctccaattacaaatatgttaggccacttgatgtgcactggtactctttcattttttagccattttctctctgttttattctgatagtttatgttgctctgtctaaaggtttattcgttttttttctgcaatgacaatctgttgttaggttactttattgaatttttttcatctcagatactgtatttttctctagaattttaatttaagtcttttaatatcttctgtttatttcttcattgtcttcatgtttttctctacctatttgtatacatggcagaaatttataactgctgttttatggcctttgtctattaattctgtaatctgtgttatttatgtttttattctattgactgatttttctccttattatggatcacattttcttatttctttgcatgcctggtaatttttttttttattatactttaagttccgggatacatgtgcagaacgtgcaggtttgttacataggtatacacgtgccatggtggtttgcttcacccatcaacccgtcatctacattaggtatttatcctaatgctatccctcccctagcccccaacccccgacgggccccggtgtgtgatgttcgcctccctgtgtccatgtgttctcattgtccaactcccacttatgagtgaaaacatgcggtgtttggttttctgttcttgtgttagtttgctgagaatgatggtctccagcttcatccatgtccgtgcaaaggacatgagctcatcgttttttatggctgtgcatgcctggtagttctttattggactgcagacattttgtggcagattgttgtgtgttggttgtttttgtattcctttatgtgtttttgcgctttgttctggaacaaagctaagttacttagaaaaattttgctaagttaagccttgattttaagctttgctaggcagatctataacaaccctgcatctagagtgactttctcagcattaaggcaatcctctattgagaaaaactattgctacgttgattctgagcctctttacttttcatgctattgtaaacactattttactttgttttgtaattgttcatggctgatatatagaaatacagaaactatgctgaacttattaatttgaataatctatagatccttttgaattttctatattcacaattatacccctgaaaatgacaattttaatttttccttttcaattgcatttctatctttcctttttttggctaggatctctagtacgatgctgattaaaagtttagatagtcgtcatccttggctcactcctgatcttaaaggggaaactactaaaattacatcattcagtatgatgtttgctgtagtcttgtttgtagctactcttcatcagatgaaggaaattcctatctattcctagtttttaagactttttattagcaatagaacattttttttgagacaggatcttgctatgttgcccaggctggtcttgaactcctggattcaagtgatcctgctgcctcagcttcccgattagctggactacaggtgcatgtgagcatgcccagtaatgtaacatttttcttaatgattgaaatatttatatgattcttttcccctttatttggttaatgtgatgaattatgttgattttaaaattttaagccacgcttgcatttttgaaataactccaacttgttcatgatgttttcttttatatatatttcttttttcacttttatttaagttcaggggtacatgtacgggtttgttatatgtcatgggggtttgtcgtacagattatttcatcacccaggtattaaaccttgtacccattagttatattttcctgattctctccctcctcccaatgtccaccgtccaataggccccagtgcgtgttgttcccctatatgtgtccacgtgttctcatcatttagctcccatttataagtgagaacatgcaatatttggttttctgttcctgtgttagttttctaaggataatggcctccagatccttccatgttcctatatatttatttattcgctttgcaaatcttttgttttgaatgtttacatctctatgggtgagaatcacttgtagttctcttttctttacaatgttttaatcagattttggtatcaaagttatgttggccttataatgtggttgaaatatcctctcattttctctttgtagaaagagattgtgtatcgttgtccttatttttgctttaaatgtttggttgaagtctccaaagacatctaggcttgaagctttatttgtgggaagatgttaattacagagtactttttagtcgttataggactaatcaaataatctactaaatccattgtttttgtcttgatgttttgattttcctttcttagagatttctgggagaatatcctagcgagggcttccagatcactaatttaatatttggccattttttttctctcaattttccttcagttaaaaaaaattctaaaaacaaagttttaaatttcttatagatcagactgatgtattttcatagtagtgtgttcttattttattgttttaacatcctgttgactttttctggggtgactaaatgagcctctttctcctggggataattgtttaatatgttcatcttgcttctttttcattgtcatggttttcttcaaggatttgatgattcttgagtgcctattcatatttatcaaagaagatcttagctcatcatttggatccaatacagttttccttagtagttataggagcacattgtcacaataaacctctttgctgaatggaggattgagtaatttgccctgtgtacacaggagtatatatgctgacagacttctctcaagagtattttggtatgaaatttctagacaagccagatattgttgttattggcaaaaaaagtcattatcctgaagtagaacactttaatgtattaacgcctatgcagagttgtgttttccccatttccccccatttctttcttttcatgcatttatgtatttattttggttagttaattattttaattgtaaatacaaagcgtatgtttttatggtgtacaacatgatgttttgaaatttgtatacattatggaatgtctaaatcaagctaattttcatgtgcattctctcacagacttttttgtggcaaaaacacttaaaatctacttttcttggcaattttccagtatacactacattgttgtgcactgcagtcactgtagtcactattgttgtacaatagatcttttgaacttattcctcttgctaactgaaattttgtgtgctttgaccaacatcacatcatttttattgagaattgaagatatcactagagtcccaacacacataatagatattccttatggaatatactctgtgttttaaaagtaactgatgtggccaggtgtgaggctcacacctgtaggcccagcactttgggaagctgaggtgagagaatcgcttgagcccaggagtttgagaccagcctgggcaacaaaatgagaccctgtctttacaaaaaaaaaaaaaaaaagatacaaaaattagttaggcggggtggtatgcacctgcagtcccagctacttgggaggctgaggtgggaggattgcttagcccaggaagttgagggtgcagtaagctgtgatcatgccactaaactccatcctgggtgacagaaagagactctatctcctaaaaaaataattgatgtttagactaaaataccgtatccatgtactctttatttacaacttggtactgaggttggaaggtgtaaatgattctttcacctgttctccaatattttatcactataacagtttttctattacctgcttgtgcttcctgtttttgcttccccaaagctttgaatttcatcctatgaagaaccattttaaagcatgtctcttacctctgtgacagtaatctccctcctctattttacatggcactgtttatgctctatcaatattataactatatcttgcagaaattcttcagtgttttggtataattatagttcccctttccatatttttgtattgaaatatattatcttctttttattttctattatttcaatttcagtagtaattttgggcatttaaggagttaaatggttgcactcatttcacagtctcaaaataaaagttcatatatctttctaacagtggcctctttgcttccctttactactgaaccttttctcttgcttgtcctgagttgcaaggaggtggtagatatttcctggtttccaaattgttgcgctaatttaatttaatttatttttccccatgtagcaatcctctataatccatggcaggtttggagaatttctaaaatattgtttattatcaacctttctttctggtaaatcagagttattagcttaaaacttttagtacaactatttaatataaattttagataatagatgtcacataaaagcttgaccaagaagaataggtaggattcttccgattacattgtatcagagcaaaatgggcctttaaagaccattcattctaactccatcattatacatatgtgggataaactgagttaaatgaattgcttcagttcccacagctagttagggatagaaccaagagtatgtcttagttcatttgtgttttgcactataacattatgcttctcaccataaaatgatgatgacaatgaactctgttctttcaggttaccaaagtcaagtccaaagtcaattccctggctttcaaattttctgataatgtgaccccgtctgtgttttatcaccttttcagctacatttatttctccagcaaactggactgctacttttgaacttgtctcttggtatggttttctcttcttttatgaatatcttttccccttcatcaatcaattgcttaattcttattcatcattcagggacatgtctcccatgaagctttcttttcttatttttgacttttattttagattcaagggctacatatgccactttgttacctgggtcccatgaagctttcttggcctttcccagtcatcagcaatgattcccacgtttatgttcctatggtatttttcaagtgtattttatggttcttgtcaaaacctgtgagctttagcatatattggagtgttttttatgatggtccctttggagtgacaataagcctctttcaccagtaatcatgtgccaaggagtatgaaggagtcacattacctcatcataatgtgatgaaaagagggacacagtgtcattttcaggactgggtcaatattcttctcataaagaataggaatctggaagagaaagtcactaaaactggctaactgttggagagaacagaaatggatctggaaagttccccttgtggatatgaataatttcctggttaagtctgatgtcctgtctaattgtgagtagacattatctgggtaaagttctaagagtagatcaagtaggcccttgaagagaggacacaaaattatttgagtctgataatggtgaccagtttattcctgaagggagaactgtgattggttctgtccaataacatgactatgcctatgatgacatggtagttgagtggggcaatagtgggaaaatgctacagagaattcttaccttcagaggctataagttacggtaggtactactactcgacacttggagatactggagtatacttacgtaatctttagagtccagagagcattggagggacttggagagactgggggaaattttgtccatatttgttggtgttattttcattttaatcatatctctttctactgtgcctggctatccagtggtgaactttttgtattctaggcaggggttcagccaaacaaaaggttataaatctgctagtatttaagtgatgctatttgtcttacattagttgttcttatactaatgctatttcccttgctagaatataagcaaagatggagctgacacatcagggagcaggttgagtttgtctccatgttcctttcttggcctctcttttctacttttaagtgtctggtttggcacagaacttgattccgagaggtgtttttgactgactgagcacatgttgaaagttttattttctgaagcatagtgttggagacacggccatactgggggacaaggtggctttctaaacattttcctaagcacttactgaattattaagcattttcctctttgtgtcaaaaccaagatcaagccatattctccagtctcataaaatgatggataagggttcgttttttaaattggtatcagatgaggcacctttagttatcgatgaacttttctcaaagctgcagatgggccaactattgcaaaattttttttttattttagtttatttttaatttattttttattttattttattttaatttaattttaatttttttattttaatttgtgatggtagccataaaaattcaacaacaaaaagaaatagtttaattttttattggatggttttatccatgtctgaagacgagggaataatttttaaggtcttaagctaagtgcccttttcactcacttccccacattcttagacaactaattcacagtcacctctgtttaaacatccgatatcttctcctccattcttactttgcactgggaaaacagaaacaattagaaggcaaattcctcatgctcttaccatgtcatttatctacctctcataatctgtactcatataacttgcctcccatttctcagagctgtgtactgcgaactcatgttaatctctcaatttgtaccttgcattctactaaagagcagcccttcaacaagtctcacctctctctcctgcttcaccaacctttctttttctaccaattgatttccctctgttgacaaacatgctgtaatatcttctatcataaaaatatgcaaaacaacttttttgacttcccattccttttctgctttttgaagtgtatctctgcttctctttacagcaaaatttctcagaagaattttctatactcactgtttcccttttcttattcactaataaatccattgcagtcaagttttccatttcatcacttcactgaaacttttcttgccatgtttgccaaggacttctgctttatcaaatccaatggtcaaatctcattgctcatcataccaaatctttcagcagtacctgaaactgtttgctttccttttcttcttgaaatgttaccatcccttggcttctgtcatcccattctctcttaattgtccttctacctcactggctactttcagctttcttcactcctttcctttcctgcctacgaaactttgggggaggccctcaggctcagtcctaagcccttcccttctttccctaggggatcttgtcaatgactataaatatgatctatatggtaacaactgtcgtatttccagccttaacttcttttctaactgatttattttcagcatctccactcagatggatggcccaaacaaaattcttgagtgcctgtcttctcctataatgaaaaccaaaaccccatcagcagtaaacctcctcctccagctcagtaaatgtcatcctactctcacttttttgccccagtgtataagaccactaaccctgcagtaataatttatgcctccctcacataccccaaatttcagcaacttctgtcagcttcctttggaattataccacctcccttgctttcacacaagactacaccaccatcatcatatgggatattgtaacctcctcctaacttttacttgccttaatgtcatcattacagagaggccttctctggccattttccatagcattttataccatcaggtatatgagttacatgtttattgtcagtctttccccaataataatataagctccttgatgataaaaagttttgtctgttttgttcattcctgtttgtaacagcaaatacatggcacacattaggaactaaaatatttatttaatgaatggctcctgatccccatctccccattattttgccatgtctaaatgcctgaatgtcatctcttttatgtatattcattactctctacaccctccattcactgtatttaaattatctatgaacttacctttacctgccacccagtttggagcaggtggtttaaagttaacaggcatcagacagaaagcagagctactcagctcgtttttatgtccatgttttccaacaaggagaagggccatcaaattggaaatgatagattgattcataaccagaagaggtactgtcccatgagggaacatttggtattgggcgagtgggttctttggttacacaataactggcggaggggagcatgctgctggtatttagtgggtaggagacagatgtactgaagtcttataagagaattgccccacctcaaatgccagtagtgctgtcattgcaatatatgagaataagctttgaagagaaggaattatattccaaaagagtttggacaacaaacaaataaatgaattcagtttgtacgacaggtaaattgcatcccagaacactaaaagaactttatgatattatgtttgagcccttgtctatatccttggaagaattattgcaaataggagatggaagagaagccaatttagtatccaaacaagaaagtcaagtctcaatgtggtgtaatcacatctcattaattatcaaaagtcatgtttctaagattgataacccactgtaattcactttggttcaaatctatagatatttactgagcatcccttgcttcttagcccatggttggtgatatggtttggctgtgtccccatccaaatctcatcctgaattgtaacctccactgtgggagggacatggtaggaggtaattgaatcatgggggcagttacctctatgtgattctcatgatagtgagtgagttctcatgagatctgatggttttataaggggttctcccccacttccctctcattttctttcttgcctgccaccataaaggaaatgcctttcactttccaccatatttgtgaagcctccccagccacgtggaactatgagtccattaaacctctttttccttataaattacccagcttcaggtatgtctttatcagcagcgtgaaaatggactaatacagtaaattggtaccaggagtggggcaatgctgtaaagataccagaaaatgtggaagatattttggatatgggtaataggcagaggttggaacagtttggagggctcagaagaagacaggaaaatgtgggaaagtttggaactttctagagacttggtgggctcagaagacaggaagatgtgggaaaatttggagtttcctaaagacttgttgaatggctttgaccaaaatgccaacagtgatatggacaataatatccaggcttaggtggtttcagatggaaatgagaaacttactgggaactggagtaaaggttactcgtgctatgcaaagagactggaggcattttgccccgtccctagagatctgcggatctttgaacttgagagagatgatttggggtacctggtgaaagaaatttctaagcagtaaaccattcaagaggtgacagagcataaaagttgggaaaatttgcagcctgacaatgcaataggaaagaaacccattttctggggagaaagtcaagcctgctacagaaatttgcataatgaatgaggagccaaatgctaatcaccaaaacaatgtggaaaatgtctccagggcatgtcagagaccttcatggcagcctctcccatcacaggtctggaggcctaggagggaaaaatggttttctgtgctgggccctgggcccccctgttctgtacaacctcaggagatggtgccctacatcccagatgcttcatttccagccatggctaaaaggggccaatgtacagctcaggccattgcttcagagggtgcaagccccaagctttggcagtttatatgtggtgtttggcccgtgggtgcacataagtcaagaattaaggtttgggaacctccgcctagatttcagaggatgtatggaaatgcctggatgtccaggcagaagtttgctgcagaggcagtgccctcatggagaacctctgctagagtagtgtggaagggaaatgtgaggtcagagccccaatacagagtccccactggggcactgcttagtggacctgtgagaagagggctactgtcctccagaccccagaatggtagttccacctacagcttgcatcatgtgcctggaaaagtcacagacactcaatgccagccaagaaagcagccaggagaggggcagtaccctgcaaatccacaggggcaaagcttcccaaggctgtgggagaccacctcttgcatcagtgtgatctggatgtgatttatggagtcaaaggaggtcattttggaactttaaggtttaataactgccctactgaatttcagactttcatggggcctgtagcccctttgttttggccaatttctcccatttggaatgggtatatttacccaatgcctgtacccccattgtatctaggaagtaactaactttcttgcaattttacaggctcataggtggaagggacttgtgtcagatgagactttggacttggacatttgagttcatgctggaatgagttaagactttgggggactgttgggaaggcatgactgtgttttgaaatgtgaggacatgagatttgggatgggccaggggcagaatgatatggtttggctgtgtctcctcccaagtctcatcttgaactgtagttcctagaatccccacgtgtcatggaagggacctggtgggaggtaactgaatcatggaggtggttacctccatgctgttcttgtgacagtgaatgagtttccatgagagctgatggttttataagggatttccccctctttgctctcatttcctttcttgtctaccttcacgtaagacatgactttcaccttctaccatgattgtgaggcctccccagccacatggaactgtgagtccattaaacttctttttatttataaattactaaatctcaggtttgtatttatcagcagtgtgagaatggactaatagagttagtcttctctcatcttatttggccactgcacagcataatctttccagctctagaatatgaagattctaaaatttataacctaagtgacaaaagagagcaaatagtcattacttaaagattcttccaagaagaacagctccttatctggcagcagctacttggagtatgcgtgtttggatttgatggaactagtcctttctgttgtaaaaattcttatttgaattatgaagtttcatatcttttgaacagctgagttagcagcatggggcatatgtgtgtcctgctttagttctgtagagaaaaacaggcactgtcttttctggccaatcttcctcttcactgctgccccagctgcttcatggtgtctagtatcaccctctgccactgagaaaaagaagcatagagatatgacttatatcatgggctgttctccaactcccctctcctggggcagggaggagaagacaaatataattgtgttttgcttatggtgccctttctcctctttcccacctatccattgtgcaggtgtttgcttttatgatatctatagtaagtattttagtgaagcccagagcaacaaagtctgccactgcttttagtaaacaaaccagttttagttatagcaaagcagacaggccttaagttggtgccattttgctcaggattcagtcactgtgagataaattggtgctagagcctctcccaagtgtcacatattgtgataatctgtgttctgaaatttcctcaaaaggttttctgtttccttggaactttgctcttatctaagtttcagctggctgtttttcaaagacttagcaggttcatatgttacctctcaaccctgctaagttacttataatttgtctgagctcttcaatgtataaatatagtggaatggttctaatggtgaacacagcagccactgtaacagaactgtgaggacagagtcctcccatggcagagaattggagtattcacttccttaaattttcaggtaccccaagatgtatatactgatggtgagcagttccttatggaggctggtggtggaatagtacaagaacagctctttggatatatcaatttctgctaaaggagatctgagtctaatgtatacaattataatcaaagcaataaaataatggcaataatagctgcctcttatatagagcttactatgtgctgagagtactgttttaagtaacttacctatattaatgcatttaaacctacaaagtaaattttggtctagagctgtggacacttggcagcttccacctacattttagaggatgtattggaaagcctaagtacccagatggaaatcagttgcagggacagagctgccaaagctacaggggcagagccacctccaccagagcaatgcctagtggagccacagggatggagctaccactgggactgcagaattgtagaactactggtgtggaatgccagcctggaaaaactgcaggcatccaactccaacctgtaagagtagccatgtgaggtgtgcccgggaaagccatgggagcaaggctacccaagaccttgggagcccactcctcacatcagtgtgcccaggaggtagcacatagtgtgaattactatactagagtgctaagatttaatgtctgccctgctgggtttcagacttgcttggggcttgtcattcctttcttttggcttatttctcccttttgaaatgggaatgtttaccaaatgtctgttccaccatggtatcctggaagtaaataacttgtttttattttataggctcatacctggaaggagcttgccttaagtctcagatgagaatttgaactttggacttttgagcagatgcagaaatgagttaagacttgggactatttgagatggaatgatcgtatttcgtatgtaagaataacatgagttttgaagggctaggaggaaaatgctatggtttggacatggtttgtttgtctccacaaaatattatgttgaaatttgatccctagtgtggcagtgatgtgatgtggggcctagtggtaggtgtttgggtcataggggtggatccctcatgaatggcttggtgcattttttatgatagtcagtgagttcttattctggcatgactagattagttctcccaaaaatgtattagctcccgtgagaagcgagtttgttatcaaagtcaggatactccttgggttttgtctcttcacacatgtccacttcccctttgaccttctccaccatattatgatgcagcccagagatcctccccacaagccagggccatccccttgaacttccctgcctgcagaaccatgagcaaaataaaccgcttttcttttttttattattattatattttaagttctagggtacatgtgcacaacgtgcaggtttgttacatatgtatacatgtgccatgttggtgtggtgcacccattaactcatcatttacattaggtatatctcctaatgctatccctgccccttccccccaccccacgacagtccccggtgtatgctgttccctttcctgtgtccaagtgttctcattgttcgattcccacctatgagtgagaacatgcggtgtttggttttttgtccttgcgatagtttgctgagaatgatggtttccagcttcatccatgtgcctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcttgtccagcacctgttgtttcctgactttttaatgatcgccattctaacaggtgtgagatggtatctcattgtggttttgatttgcatttctctgatggccagtgatgatgagcgttttttcatgtgtctgttggctgcataaacgtcttcttttgagaagtgtctgttcatatcctttgcccattttttgatggggttgttttttttttcttgtaaatttgtttgagttcattgtagattccggatattagccctttgtcagatgagtaggttacaaaaattttctcctgttctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtccttgcccatgcctatgtccttgcccatgcctgtgtcctgaatggtattccctaggttttcttctagggtttttatgattttaggtctaacatttaagtgttattctaagccaaaagaacaaagctggaggcatcacactacctgagttcaaactatactacaatgctacagtaaccaaaacagcatggtactggtaccaaaacagagatatagaccaatggaacagaagagagccctcagaaataataccacacatctacaaccatctgatctttgacaaacctgacaaaaacaagaaatggggaaaggattccccatttaataaatggtgctgggagaactggctagccatatgtagaaagctgaaactggatcccttccttacaccttatacaaaaattaattcaagatggattaagtgcttttctttataaattacccagtttcaggtattctgttataagcaacagaaagcagactgagacagtctcatttccattttagagttgggaaatctggggtacagaagagctcaatgacttttgtgacgtcagagagctagaaagtgataaaactgtgagttcatcccaaccaactttggccccagagtccatgcacttaacggcttctcagttcttcccttactcaattcctgcaatacttctctttgagactatcacattgtcctttgttaactacacttttaatagctatgcttcaagtagttgtaatagtcttggggagttactttatttctatgtgcctctgtttcaatgtaagcaaaatgggacatttttaacagggctggtgtgagatttgtaggagttctcctacataaagcatatagcattgctcagggcacataaagggagtttgatgttaacataatttgaatttaataacctaaccttgcccaagcctttattacaaggactgtcagactttcagtacatcagaatcatctagtctgttttaaaagtgcagatttgtttgtcccaccccaatactgatacagaagtctcttgtggaacacagaaatttccattaacaagagattctactatagataattctaaaactatagtttgagaagcactatgtatgatgaaattccctttccctccacatctgccctgttattctctctaaatatgtgtacatctaggcatatgggtgctgcattatggtaatgttctatctatatttggcataggaatatggcctttatgaaggtgctgaatatcacctgtgaggtcattcaccgggggagagaagtgtattcgtcagtttaaagatcagaatgccagatttgagtgggaggatcttaatatataatcaacacaggggaaatcaatttcttttgcattctctctctctctctgtctctctctctctttcatatcacagatggtattagcttgctcagggggagaactttgggtagtagtcgggatttgacatcttttcagtgataacaaaatgacgcagtaatcatacagtaaagaaggaatcaaggcggagtgttgcaaggtcctgccagcttttcacagcaaggcagcagatggagtaggtgggccttatataactgaactgcatatcctttttgtcttttgcacttcttgtatttgcttctttttttctctcttagtatttagaaaaataactttctttgaaaaaaatccaatctgtatcagttatgctaagtggacaaaaatgtgaaatagtttgttagataaaaatgttaagttgaggtttgttagagtgttacagaggagttcaatgacttttgtgaggtcagagagctggaaaatgataaaactgggagttcaacccaaccaattttggctccagagtctatgcacttaaccacttccctgagtaaatcgcattcactgagagaaaagtgagagtcagggaaatgtagagctggtaccttatgctcagctgtccccctcctcaacttgggactcactttctagtactaaacttctatccgtgtttgactttactatagaaggtgggtcagccaacttaatcctactacaaagatggttgaagcagcattcctctcacagctgtccccagggccagagcaggcatggatagcacggtttaacactggtaatacgtttagggcatgccagtttcttctggtagcctctgtagaaagtttcacattctcagctctagggccagattgtcatccatcctcatgacaaatttgtagcaattcttagatgatatgggtttaaccaaatttatcactattgcgtatgtgttttagtcccttaagtctttgctacgagtattgcatattgttttgctataggatatactttgactacaactcttcaaagttattttaatctgaaaacatagaaaagcacatgaaaaaatgttttaaaatgtttaaagtttaatggggagcaaaatactagttatctcattctaagaatcttatgcaaataaatgtaatatccaggttttaaggcctgagattatgctgttgttggtggatgaagtgcagggctgggtggtggggagtcaaacaatgacattcatctttgatcctttcctcattatgacccagtcgtcttgaataattgactctaccagagaattcccattcataacgggcactgacttgattctgccttatatcatatttaggtgaatacatttctacctccccattagactgtcaactccttcatgaaatggactatgactttcaactgaattgtctcccataatgtattctcaaaaaatgctcagttgaaaaaatataaggaaaacaaacaagcaaaaatcagctctgttaactatacgaaatcaattctagacctataagtcgccttcattcatagcaatttgagatgacactgaactctaatcatatctgagcatctggtctcagtaggagatatggtcaggccccatattgctctttccaaggagatcagcacaacaaaatttcctgttcatttcttatagaataaatagctctccaggtggctttctttctaccttactcagatagatactattcatatcttattgacagtagagagactaaatgcagtctgagctgcttagcaaatgatttggagatacctgtcagtgatactatgttagtgaggtttgtctagacaatgctgtggtaacagatttcccctgccccatcttgatgtccagacaaaactaacattcctttctttctttctttaagtacgtttctaagtctggttggcatgaggagctctgttccagagcctcagggacacaggctgagggcatcttatattctcatggtagaagaaaggaaatagtggattttcactgcctcagcctagaagtggctcatgctcctttcacacacattgaatgagccagaactagtagtatggttctgcctaccattatgggggctgaaaaatgtaggagagcagaaggaatatttgatgaactttactgtctgcagagataagccaaaaagcatatgagagtttgagtgggtggtggtgaattattgcattaaggtggagcctcatgacagagggttggatggtagtgacaggtatgaacagttggcagagagatagttttattctagatcattttgaattttgtgccagtaagagcagcagaaccactttttgccctccttatgaactaaattagtccagcaaaatatcagaatcctggaagtttagatttgaaaaatatcctgttgattacctaacccaaactcctttttgatacactgctgccctggaaagaaaaaaagatccttgctaaatagctgtaaaatggaaataacaatagtaacaatcaattagtgtggtttgggagaattcactaagataattgtttgtaaaatgctcagaatgatggccttgtacgtagtaagcactatataaatgttacctattttacttgaattgttctttaatcttatagtaggctgaataatgtccctcaaaatatgtccatgtcctaattctatgaacctgtgaatattttaccttacatgtcaaaagtgactttgcagatgtattaaacattcatggtgaactttttgtgtaccaagagttgttctatttgctggagacaaaacagtgtgaaaatcaggcaaactgtttaccctcatgaagatattctggtagaggggtagaaaatagacaaaaagttgatctgataagtgtgatgaagaaaaaacaacgaagtaaaggggaaggtgtatgggggtgtgagggttgctaatgtttcgtttagtaagatagtgaagtcctttatattaaggttacatttaaatagatacttggaagaagggagagaactgtgcactgagagagtattccaggcagaggtgggaacatacttgatgtatttgggaatagcaaggagttaagtgaaattatgtagaaaaacagcagtaggagttaaagttcaaaaagttatttagcgttttgtatgccaaaatgaagactttggatttcactcggagtgatttagtaagctattgtaaacattttaataaatgagtgatgcaatattacatgtgttttgaaaggctaactctggttgcaccgtaaagaataggcagtaggggttcaaagatggaagcaggaaactatggggctattaaaataggccaagctgaagatggaggtggggaactagagtggtagcagtgtaaatggatgtggccagattatgaatgttctttgaaatacagccaatatttgtccatggattggatatagggtgtgagaagaagagtgaagtaaagataactctcaagttatttgtggcatccataatggaaaggttgtaattaccgtttaatgagattgtgaagactataggaagaacagattaaggggtaaaaatctggagtttggtcttggatgtgttaagtttgaggttcacattaaggaagagatctggtctggaaatagaaattctagagtcatcggcatattaacataagtacagtgaacagcctggatatcgtttaaggagtgagcatagagaaaagagataaggtttaagcactaagctctagggctttccaacacctgaggcggagcaataaatggctagcaaaggagactaatgatgactagccaggggatgggagaaaaataaaaaagggagagtgtagtatccaggaatctaaataaataaaatctttcaagaaggaatgagtggttacttctatcaaatgttgctgaaaagtcacattaattatccataggatctggatttgccaaataattcagcgaaggtggagttaagtggtatgctatataaaaatatcagtacagccaattcaacaggaagtacaaagatagaaattgggaagcaagatggtggaataggaggttttcacttgaatataccccctgcagcaacaataatttgtcagccatccacaggaaaaaaaaaagtgtttctgtaggacctttgggattgaggtaggagtttgtgaaaactgagtggagcctaagactgggaggggctgttttgagagagcaggcctgtgccctgccttcttactgtttatggtcccagctacaaacctggatattgcctcatccccttttggatttagcgtaagccccatttagccttggttctgccaccagtactattttctaagggacatgggaggagtcacatccaacttatccccagaggcagaccttcagactttgctccctctctcaaccattttccaggagagagcctgtcttctcaaggtcccagagagagacacaatgtctatgccaatggaggcaggcctgcagaccttggtcctgtctgtgcaacttgaaacagccccgtgacttaattccaccactgcttagctgcaatccagggtcagtcttgccttccaaaggatattgatatggtttggctgtgtcccaacccaaatctcaccttcaattgtaataatccccactgtcaagggcagggccaggtggagataattgaatcatgggggcgattcccccatactgttctcgtggtagtgaataagtctcatgagatctgatggctttataaatgggagttcttctgcacaagctctcttgcctgccatcatgtaagatgtgactttgctcctcatttgctttcagccatgattgtgaggcctccccagccatgtggaactgtgagtttattaaacctctttcctttataaattacctagtctcaggtatgtctttattagcagtgtgaaaactgactaattcagacatgctcagtgaaccagtgagagctttctaagggatgcagtgggaaccacactggtttatgcacctggtaacagacttcttgtttgtggatccaactgcagatccaattgtaggcccttgttccagcaccaaccccactgaccaatttcctggaggcagtcctgtcttcccagggaccacataggattcatgctcaactgagcctcaagtaaaaggcctaccaactgtagacttcactacagatccagcagcatccatgtgacccagctccaaccacacttaactgtgataccagaggaaatcccatcagcctgagggcccaacaggagaaagtcactgcctgccaaaaccagtttgtaaagactggaagaggtgttttctctttcaaatgcacagataccaacacaaggctacatgcatgaatcatgaagaatcaaataaacatgacaacactaaagggaactattaaatcaccagtaactgattccaaataaatgagaagatctacaaatttcctgacaagaatttgaaataatcatcatacggaagcttaatgggatgcaagaggactgtgttagtctgttctcacactgctagtaaagaaatacctgagactgggtaatttataaagaaaataggtttaattgactcacggttcagcatggctaggaaagcctcaggaaacttacaattatggtggaagggcaagcaaacacatctttcttcacaaagcatcaggacagagaagaatgagagcagagcgaagtgggaagccccttataaaaccatcagatctcacgagaacttactatcacaagaatagcatggggaaaaccgcccccatgattcaattacctcccacctggaccttcccaccacacatggggattatgggaactacaattcaagatgacattcaggtggggacacagccaaatcatatcataccacccctgacccctcccaaatttcatgtcctcacatttcaaaacacaatcatgcctttccaacagtcccccaaagtcttagctcattccagcattagtcaaaagtccaagtaaaaagtctcatctgagacaaggcaagtctcttctacctatgagcttgtaaaatcaaaagcaagtcaattacttcctagatacaatggaggtacaggcattggataaatacacccattccaaaagggagaaatttgccaaaacaaagggctacaggccccataccagtttgaaatccaatgaggcagtaattaaatcttaaagctccaaaataatctcctgtgactccatgtctcacatctaggtcatgctgatgcaagaggtgggctcccatggccataggcagatccacccctgtggcattgcagggtacagccccccctcccagatgtttccacgggccagtgttgagtgcctgtggcttttctagatgcatgggggcaagctgtaggtggatctaccattctggggcctggaggacggtagccctcttctcacagctccaacaggcagtgccccagtggggactgtgtgtgggggctccaaccccacatttgccttccatgttgtcctagcagagggtctccatgagggctccactactgcagcaaacttctgcctggacatccaggtgtttccattcatcctctgaaatctaggcagaagttcccaaacctcaattcttgacttctgtgcacccataggctcaacaccatgtggaagctgccaaggcttagggtttacattctgtgaagccatagcccgagctgtaccttggcctcttttagccacactgaaacagctgggatgcagggcaccaagtccctaggctgcacatagcaggaggtactgggcctgacccaggaaaccatttttcctcctaggcctttgggcctgtgatcaaaggggctgccatgaaagtctctaacatgccctggagacattttttttcattgtcttggtgattaacattcagctccttgttatttatgcaaatttctgcagctggcttgaatttctccccagaaaatgggttcttctcttctattgcattgtcaggctgcaaatttttcaaactcttatgctctgcttcctcttgaatgctttgctgcttagaaatttcttctgccaagtcttgctttggctatgtgggctcatttttggttccatatgaattttaggattttctttctagttctatgaataatggtggttgtattttaatgggaattgcattaaatttgtagattgcttttggcagtatggtcatttttacaatattgattctacccatccatgagcattagaagtgtttccattttttttgtgtgtgtgttgtgtatgatttctttcagcagtgttttgcagttttccttgcagaggtctttcacctccttggttaggtatattcttaaatattttattttatttttgcagctattgtaaaaggggttaagttcttgatttgattctcagcttggtcgctgttggtgtatagaagagctactgatttgtgtacattaatattgtatctggaaactttgccaagttctttttcagttgtaggagctttctggaggagtctttagggttttctaggtaaatcatatcatcaccaaacagcaacagtttgacttcctctttaccgatttggatgccccttatttctttctctagtctgattgctctggctaagatttccagcactatgttgaatagaagtggtgagagtgggcaaacttgtcttgttccagttctcagagggaatgctttcagcttttccccattcagtgttatgttggctgtgggtttgtcacagatggcttttattacactgaaatctggaggtatcacattatctgacttcacattatactataaggtcatagtgaccaaaacagcatggtactggtataaaaataggcatataccaatgatacagaatagagaacccagaaataaaccccaaattcttaagccaactgatcttcgacaaagcaaacaaaaacatacaagtggggaatggacaccatattcaacaaatggtactgggataattggcaagccacatgcaggagaattaaactggatcctcatctctcaccttatacaaaaatcaactcaaggtggattaaggacttaaacctaagacctgaaactatagaaattccagaagacaacattggaaaaacccttatagacattggctttgtcaaggatttcatgaccaagaacccaaaagcaaatgcaataaaaacaaagataaatagctgggacttaattaaactaaagagcttttgcatggcaaaaggaacagtcggcagagtaaacagacaatccacagagtgggagaaaatcttcacaatctatacatctgacaaaggactaatatccagaatctacagggaactcaaaaaagctagcaagaaaaaaacaatgccatcgaaaagtgggctaaggacatgaatagacaattctcaaaagaaaatatacaaatggccagtaaacatatgaaaaaatgctcaacatcactaatgatcagggaaatgcaaatgaaaactacaatgtgataccaccttactcctgcaagaatggccataatcaaaaaatcggaaaaaaaaaatgatagatgttggcatggatgcagtggacagggaacacttctacgttgctggtaggaatgtaaactactatgaccactatggaaaacagtgtggagattccttagagaactaaaagtagaactaccatttgatctggcaattctgctactgggtatctaactagaggaaaagaagtcatgatacgaaaaagatacttgcacatgcatgttcatagcagcacaattcacaattgcaaaaatgaggagccaacccaaatgtccatcaatcaatgagtgtataaagaaactgtggtatatatatatatatgatggaatgctactcagtcataaaaaggaatgacttagtggcattcacagcaacctggatgagattggagactattattctaagtgaagtaactcaggaatggaaaaccaaacatcgtatgttctcactcataagtgggagccaagctatgaggatgcaagggcataagaatgacccaatagactttggggactcagggagaaaggtgggaagcgggtgaggaaaaaacgactacaaatcgggttcagtgtatactgcttgggtgatgcgtgcaccaaaatctcacaaatcaccactaaagaacttactcatgtaaccaaataccacctatgccccccaaacctatggaaataaaaaaataaaaaaaaagacacttcttattccagatactttaaatcatctctctcaagtttaaagctccacagatctctagggcaggggcaaaatgccagcagtatcttcgctaaagcataacaagagtcacttttgctccagtcctcaacaagttcctcatctccatctgagaccacttcagcctggacttcatcgtccattccactatcagcattttggtgaaagtcattcaacaagtcgctaggaagttccaaactttcccacatcttcctgtcttctgagccctccaggtctctaggaagttccaaactttcccacattttcctgtcttcttctgagccctctaaactgttccaacctctgcctgtttcccagttcctaagtcactttcacattttcaggtatccttatagcagcaagccactctagcagtaccaatctactatattaattcattcttgtgctgctaataaagacatgagggagactgggcaatttaaaagaaaagaggttagattgactcacagttcagcatggctggggaggcctcaggaaacttagacttattgtagaaggagaagcaaacacatcctttttttattatactttaagttttagggtacatgtgcacaacgtgcaggtttgttacatatgtatacatgtgccatgttggtgtgcggcacccattaactcgtcatttaacattaagtatatctcctaatgctatccctcccccctccccactccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtgcctacaaaggacatgaactcatccttttttatggctgcatagtattccatggtgtatatgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggattgctgggtcacatggtatttctagttctagatccctgaggaatcgccacactgacttccacaatggttgaactagtttacagtcccaccgacagtgtaaaagtgttcctgtttctccacatcctctccagcacctgttgtttcctgactttttaatgatcgccattctaacaggtgtgagatggtatctcactgtggttttgatttgcatttctctgatggccagtgatgatgagcattttttcatgtgtctgttggctgcataaatgtcttcttttgagaagtgtctgttcatatcctttgcccactttttgatgggattgtttgttttttctcttgtaaatttgtttgagttcattgtagattctggatattagcccttcgtcagctgagtagattgcaaaaattttctccttttttttttaaaaaaaaaaaagatgccaggaaggagaagaatgagagctgagtgaagggggaagccccttatgaaaccatctgacctcgtgagaacttaatatcacaagaatagcctgggaaaaaccacccccacgtttctattaccttccaccaggtctctcccactacatgtggggactatgagaactacaattcaatatgagatttgggtggggacacagccaaaccatatcaagaacacagaatactaaatgaaatgaggacaatacatgagcaaaataagaagtttaatgaagaaacataaactgtaaaaaatgaccaaacagctgaagaatgtgacagaaaagacaaattcaagacagagcttcagaagcagacttgatcatatgatttactaatcccactactgggtatatacccaaaggaaatgaaacaattatcttgaagaaatatctgcacccctatgtccatttcagcattatttacaatagctaagatatagaggcagtctctgtccatcaacagatgaatggataaataaaatgttgcacatatagacaatggagtacgattaagccataaaaaagtaatcctgacatttgtgacaacatggatgaacctggaggacattatgctaagcaaaactagccagacaaagaaagacttatatgtagaatctagaacagtcaaagaagacagtagaacagtggttgccagaggctgtggaattggggaagtagggagatttcggtcaaaactttaacttacaaaataagttctggcaatatgatatacagaatggtgaatatagttaataataagtatacttaaaatttgttaaagctgtagatcttaagcattcacacctcctaataaagaaaaaaagcagaaactatgtgaggtagtggtgtgttaatttagcttgattgttataataatttcacaatatatactacgccaaattatatattgtatacactttaactgtatacaacttgaattttctaatcatgcctcaataaaacttggaaaatataaaaaatcggggatagggagtgagtttagatgactttttaaaagagtgttgctgtaaaggcagcaaatgagattgtagctgggagaagacgtgggtttaagagaaaggtttcaaaaatgagatgtatcacagaatgctgatgaggattctccagtaaaaagaaataagtagtgattcacaagagagtagaatttctatagtgttatccttaaaaggacagagaagttgacacacagttcacaagtggaggggtaagagcaaggacagtttatccatagtcactaaaaagaaagcataatatgtatgcacgatactggtgggcaaggagatgtgggaagcatatagacattctcttctgatggcctagattttcttaatgaaatagaaagcaagggcatcaattgagagggaggataggaaggaggtgaggcaatttcagtaaagagaaggtgagaaatggtcttcttggagagtgggaaaatagatggaaaggacatgtggtaggattgttgaacagcaccaaagatcagcttgaatttggagaagccaacttggttatgtatttttggtccagttacattcacatattcagctgctcagtcaggcacggcttaagagtaggcaatgaattagatttaaccagaattttgttttgctaatttagtatgatgaagggagatagagacaaggaagtttattgtgttgtgtgcacaaggaagtgattagaatgatggaccatgccatggactttaagttggctatggaggaatgtgatggcatgagtgagggcaggggaaagttgatagaataaatgaactgtaagatttatcttagtactcaatcagctgaatgtttgtgtcatccttggatattgagaaaatgctcctaagccccattcagcagcagacaacatttgagttcaatatgcgtaatggaatagattcatatcctgtttgcaggtaatgtggagttgtacaaagcgggacaagtgtgaatagctgagggctctagtcctggttcttcagtaccttgttgcctgtctctgagcaagtcatttctcttttgggagtctcagtttattcattatttgaaatatgcagaacatgatctttggttcatttatattaattgcagggaggaatcaagtgagataataaatgcaaaggcatttggcaaaatggaaagtattctaaaagctactatttctttgtcacagtagtaatgacgacagcaataataatgaaaccattattttttacatttcagagattgttttaattactttaaatgtattatctcgtaattcttatgagagcatattctctgcttgctattatttatttccatttacaaataaataaactgaagcctagaaggttaaataacttttttaaggtcaaaaaactatttctgagtatgtggtttatacacagacctgtctgtcttcaaagctgatgtctttttggtcaacattttgtttgtaaaattaagatatctgaatacatatcatttattgcgcttttatacttattatctcacatgatttccccctcaccagctattatagatttcacatgatctataatttgtctatagtcatctattggaggcctgtctaatctaagttctgccgcttcagccttgtgtaattatccaaatctcctttgctaggcagatagagtagggagctaaatattatactttaatcacagactgagctggtggaagctggcatttagtttaatgaatctcaatttaccatttctatggcttgtaccccaggacatttatttgagtacatggcaggtctttgtaacctcagtgctaagagactatgggcatttttttttcctgtgtgattcagaggtttttgaattatttctttagcctcttgccctgtgaagattcagaatttggcaaatcttttgagggagagaccagctgtgcatttagcatccttcaagactccaattttgtcattaccgtctgccaaaagttctgccaaggaccaagtgtggattcttatctttcagcaggttccagatctgcaaaaggtggttggaagatgtgggtgttaatttactactccctctaatgctttcatatgttatttgttcttagtcctgccaatcctgtacccccaacctttgcctcctaatcacctagagactgtggaaataattctactttgctttaagttttggcttaatctctttatcttcctcttcagtttagctttggagtttagcaaatatcttgaaggagaaataaattgtctatttgaggcctgtctaatctacatttttttacttcagctctgtgtagctgtcaaaaagtccatcagcagcagctctccacctagacctagctcaaattctcaagctcagatccatgttcagaatcaggacatattctcggagacagctgtggagcctcagtttacctccgaaagactgtcctcattctggaattgtattccctctagtcttgcttacttctacagttattgggtgtctataaatatatatataatttttgaaatctatcttttttctaattgttttcagtggaaatattgacctgccatgaactattccattttactcagaagtagaagtcaaatcctgtaagttttaataaatagtaagtttactaaatagtatttttgctattattcagttcataatattttcgatttccgttggattatttacaagcatattgcttaacttctaaacaatgggacttttctagttactttttcattattgtttcctaatatgattatattatagctaaaaaattattttatgattttgttcatttgaaatatgtagataattgtattatggcccagcaaaatggacagttctctacatgttgtgtgggtatttggagaatatgtattctatagttacttggtttaatgttcttttgcatattctttgtctttgctaacttgtttgtgtttattccatcatttactgatgaaagtgtattaaattttaccatgtttctgggtttttctttttcttcttttactactgtcagtgttttctttagatattttgaagacatgttactaagtatataaatttagaatagttaatatttcctcataaatttaattcttaatttttacctactattgtcatttttttctctggtaattctttttgctttaaagtcttccttatctgatgttgtcatagctataccagccacatgttggttagagtttgcatggtctttacccattcatttactttcactcttttccctttatgttttgaagttgtgttctataaatagcatatagttgagacttggcaggatccagttggacagtatttagttaattggagcattactctatgtatagttactataattacaaatacatttgcattaaaaatgttcagcttattaagtgatttctattcattccacctgcctatattcttattttctcttgcttgccttattttagaatgaatatagattgagtatattcaagcattctaaaatacacatatatactctattagcttgaagattttatacctttttgctattattttagtgtttactataaaaatggaaattcattaactcataagagtttaatatgaattgacacttttacttgcttcatgaatgctttatctatgacctatcatttattttttgtcttacattcttgtattccagcaagacattattgtttatattatcagtactctttttttttttttttttttttttttgagacggagtctcgctctgtcgcccaggctggtcggctcactgcaaactccgccttccgggttcacgccattctcctgcctcagcctcccgagtagctgggactacaggcgcccgccaccacgcccggctatttttttgtatttttaatagagacggggtttcaccgtgttatccaggatggtcttgatctcctgacctcgtgatccgcccgcctcggcctccgaaagtgctgggattacaggcgtgagccaccgcgcccggcctatcagtactctttaatattattaccattttatttcattttgttgttgttgttgcattcccaagcttccatatgggattacttttcttctgcctgaagaatgtgcttccagtttcctttagaatatattatggactgaatgcttgcgtcctctcaaagttcatatgctgaagccctaacgcccaatgtcactgtatttggagacagggtctgtgaggaggtgataaaggttaaatgaaattgtaatggtaggaccctcatttgaaaaggctggtgcccctataagaagaggaagagacaccaaagtgtgcttgctctctctctctctggcgtgctctctctctccctctctctttgtctctctctgccatttaaggacacagccggaaggcagcaatctgcaagccaatttaatattgcaaaaactcacctcatgctcccttccagtcactggtccctttccatgggtagccattgtcttgatttttaaacagaatacttgtacatgtttttaaattttatataaatggaattatatagtatgttctttattgcatctatgttcttgcactcaacattatgtttgtgatatttattcatgtttagaattgtagatcattggttctcaaactttagcatctatcacaattaccaagagggcttgttcaagcacgaatcgctgggtcacagcccagagttttgattcagtatgtctggggtggaggctgggagtccagttttcaggtgctgctaatgctgctgatccaggggccatactttgagatcactgttgtaaatcattcactctcactgatttatagcaaagatcagcaaactttttgttaaagggccagatagcaaattgcacaatccctgtaggtcaagaggcaaaattgatgactttatgtaggtaattgtataactgttaaaaatgtagccatttaaaaatgtaacaaacattcttcactaaggggctataaaaaaataagggactggtcacatttttcctgtgggctgcagttcattgactgatgatgcatagtactccattatatcacgatattacaatttgtttatcctttaaactgttgatggggatttgggtagtgtccagattttagcttttacatatgaacactgttatgagaatcctcaaacatgtcttttggtgaacacatgtatggatttctgttgggtacataccccagagtagaagtgctgtggaataaaggtatgcatgtcttcaactttaggagaaactgccgattttctaaaccggttgtatcaatttacactcccaccaacaatatgtgagaattattgttgctgcacattggtggtgttctggagctgggtcatactggctttcaaggaccaattgtgggcatctcttctcaattctgcattcagtggtctcaggatggctgcctgaaattggctatggtggtagtatttacagtatggagactggaaaaaaagccataaatcagggatcttatatattcatttctaagagagccaggtgttcaacattgaccattatctcatatctagacatttttgtcaacatttggtatttaatactttttgtctacattgtagctattcaggtggtggtatagtactatcctttgtggttttaatttgctgctttgcatctctgatgagaatgaagttaaacagcttttcaaatatttgttggatattttaatatccttttcattatgttcatttgtctagttttttagataggttgtctttttatctctatctatgttctatctatctatctatctatatatgtatgtatgtttatatattcatggtagaagttctttgccagatatgtgtatttctaatgtcatctcctatcctgtggattaccttttcattttttattggtgtttttgatgaacagatcttaattttagtgtggtctaagttaccatttctttctttaatggttagtgttttttgtgtcctatttttttttaaaaaaactttgcctataccaaagtcacaaagaggttatccttaaagatattttctataaaatatttattattttacttctgacataaaatttttcaactcatttgcaattcgtatggtgtgactttgtgatataattgcagttttttccatataagtgtgcatttaatatggcactatttatttgaaagactacactttcacctctgcactgcaatgtcacctttatgaaaaaaaaattgggtgataatatttgcctgaattctttattccattatatctataaccattccagttagtatatccttgcactaataccacagttcttatttaccatagcttgatatatggtagtgtaggtcttccagatgtgttctttttttttcaagattgcctctgactattttagctttttgcttttctacatggattttagaatcagcttgtcagtttccacaaaaatctctgctgttatcttgattgagacttgaggtaggttgaagatgtccacaaagtctttaacacttcccacagaggactatgataatgtcttcttgttttattgatccttttataattatgaaataactttgtttttctctagtattgcttcttgattttcctgattacagtttcattatctgtttttttggttcatgacttctcttcattccttttatattaaacttttgccatgttaatatttaagctatatttcttgtaactagcatatatttgggtttaaaaatccattctgaccatcttaatattttacttgtaaatatttgacttatttttattaaatttaattactgatatataatttggtttagaatatatttgccacaaaatcatcaagtttctatttgaatcacctgtttcatattcccttttacttccattcttgccttcttttagcatagtcaatgtttctatttagaatgtttttttctattaatttgtcagttatatcttcttccgctattttagtagcgaccttagaaattacagcaagaatttttgacttattacagtcaaatacaaactatttataccacatctttatgctactagaaactttaaacagtgcttaccccttttttcaccctcctgcattatttttgtcaagtattttcacttcacatttcattttgcatatagactgtacaaaatattctaattactgttttatgcaatctaaatatatatttacttttacccatgtatttattctctccggtgttcttcatgcccttttgcattttcatgtttccatctagcataattttccttttgactgaagaattttctttgtttttgtcttgttttctttcagtgttggtctgctggtgaggaattcctttaatatttgttcatatgaaagcctctttatttcacccacattgttgaataatattttctttgggtgtagaattatatgttggtagttctatgtgcttatttttactttagcacttaaaaaatgttataacattaccttctgactgaccttgtttcttttgggaattctgccttccgttttccagttgttcttctaaatgcggtgtcttttattcctctggttgctttaaagattctgtatctttttttttttttttttttttttttgcagagctagctgaggttttattttggacgaaaaaaaagcaattgaattgttttgtagttggaggcatgggcaagggtggtcctcaggcagtgaattccgccgagggtgggctgagggctagagccgagcctcaggtgtgtcttctgttccctgtgctcccctgcacagcggcctccctcccgggctctgggcaagtcgcaggaggggcagggtgggaggggctgccgcagctgttcacttgggcgggacgtcagaggacgcggacaccagcttcccatcgcgggtctcgatcttcttcacaaccggggccctggtggagctggtgcggctgaaggagctgaagcccgcgccagagccagagctggagcccaggccgtagctgaggccggggcttgtgaggcccccataggccgagctcagaccacctgcaaaaccgctggtggtcttcatatgaatactcatgttctgcatcccagactctagctggctctcttcgccctccagcagcttcccgtaggtggcgatctcgatgtccagggctagcttgacgttcatcagctcctggtactcacgcagccgcctcgccatgtcctgcttggcccgctgcagggtggcctccagctcggacagcttgacgttagcatccttaacggccagctccccaagctgctcggcatctgcgatggcggcctccacagggaagccatccggcctttgaggccctcagtctcagcctggagccagctgatgttccggttcatctcggagatctcagtctgtatgccgcaggtcatccccctgcttcccagccagcacctgcagctcctcatacttgacctggtccatgctctcagcctcagccaggctgcggttggcgatcacctcgtactacgccttgacctcagcgatgatgctttccatgtccagggagggctgttgtccacggacagcaccacagacgtatccgagatctgggaatgcagctcccggatctcctcttcatacagctgcctgaggaagttgatctcgtcagtcagcccgtccaggcgagactccagctctaccttgttcatgtcagcttcatccacatccttcttgaggaggacaaattcatttgccatctctttacgcatattgatctcatcctcattctcgtccttgaagtcctccaccagcccctgaatgttgccaagctccgtctccagcttcagcttctcctggcccagagtctccagctgccgcctaaggttgttgatgtagctctcgaacatgttgtccatgttgctctgagccatctcctgctgctgcaggaggctccacttggtctccagcatcttgttctgctgctccaggaacggtaccttgtcgatgaaggagacaaatttgcctagggtcttgatatgctccttctcctgggtgcgcacggcctggatgttggggtccacctccaggttaaggcggctcagcagactctggttgaccatgacggcggtgatgcctccgatgccgctggccccaccatagcctccgcccaggccaccccagaagctgctgctgcccactcgggagaagctggagaagctgatgcgggcaccgggcccactcgtgtagaagcggctgctgaaggcccgtgtgccagaggtggacaccttgtacgacttctgggtcaccctgatggacatggtggaggcaggagtggaggcaggtgggctgaaccaggcagagattccagaaggagcagagaagctgcttcttggtctctttgttttttttaacaacttgactatgatgtgcctaggtgtggttttctttttatttatcctgtttatgattcactgagttttttgattctgtgggtgtatgtcttttattaattttgtaaactttttgaatattatttctttaggtattgctcctgccctattctttctcttctcccattccatatttgttagttgtttttttactctgtcctacatatgtcttatgctctatctttttttcccgattatttttgttcttgtgcttcaattttaatattttctataattttggagttatacaaacctgttcttttgtgtcacatctcccattaatcccacgcactgagttcctagttttttcattgtaagatatccagttgatttttagttccattaattcaaattatctattacagttcttggttctttcacatattttatttaactttttctttacttcttttaaaaatattagtcatagttaattttaaagtcattttctcgtgatttcactatccagatactatccagatcatgtgtgtttctgcatcttttttcatcttttattttgatttacatgtcatattttttacctctttgtgtatctagtaatatttttattgcatgtcacgcaccatgtataaaaaattgtagaggcttcagatgagatattccagagacagttccacttttccccttttaggcacataagttgagcatatgcttaatttaatccagtcagaaattattcatgatgagggctagagtgcagttttattaaaactcagtctacgtctggtttgcttcttttccctaggatgtaagagcatggtagatttctattttgtaatctctgaaagcctggaaaatccagatctgctattcacaacttgcagcctcctggagtttcaaattctggcacatgcttgtttcctaagaactgggtgattgctgaagattttgcttcacctttttacaagtattttacccaactatgccagaagtcagcaaatgttcagtggggaaaatctgctgagcacttgagtatcatcagcttttgtatttgtcataccagccttgtcaaactgctaaaagctttgctgttttttctctctgcgagcagaggctctttgtctgaataagcctggtcctcagcctattctcagagttggtaaattttccaaaggagaaaaatagttgaagattgtcagcttatagtggaaaagattctctctccttgaaattttaatttatttaatctttgtttccaccactatttggtacctttaacatgatgatttttgtaaatcatccagttttttgtagttgtagaagattgttgcctctcacatacttttattcagaagcatatttgaatagattttttttttttttgacatgtagtttcgctctttttgcccaggctggagtgcaatggcgccatctcggctcaccgcaacctccgcctcccgggttcaagcgattctcctgcctcagcctcctgagtagctgggattacaggcatgcaccaccaccccggctaattttgtatttttagtacagacggggtttctccatgttggtcaggctggtcttgaactcccgacctcaggtgatccacccgcctcggcctccaaaagtgctgggattacaggcgtgagccactgcacctggcctttgaatagatatttttgatgctattataactaggatctttcaatgatttaaatgtttcttattcacttataggactaaaaaattatttttcatatattgtttttgtatccagcaattttactaaagtcccactgtaaatgtaacagtttatccatagatttttaaagaatttttatgtactcaattatataatatataaacgacagttttacacttctttttgcatacttctattcttattaatgtgttgaattgtctaggacctccactataatggtgaatagtagtgatgatggcagccattttgttacatccccaatctcaaaggccagtattttaatatattacagataagtgtaatattttgaatagatatttctagatacattgtatcatattaagttcccttgtatcctttgttttgtattttttggtatatattaaattttatcaagaactttttgcttatgcctctttatataatcaaaattttgttctctaaaatatgaatgtgctgaattacattttaaaaattttaaccagaattgccttcctgggataaatccagctaggtcgtgatgtattaggctgtttagatattggtggatatgatttatgaacattttaaaggatttgttcattcatggccatgagtcagaatggcatataattttatttgttcatacagtccttgtcaggttttgatctcaaggttatgctagcctcaaaaaaaataattttgggagtgttatacctttatttattctatggaagaggttttgttagatcgtaattactttcttcttgaattattgctggaaattgcagcaaagccattttggcctagattttctctgtgggagatgtttagtttttagtttctttgatagttataggaatattcaagtgatcctcttgttttggttttctcactgttttattgagatataatcgcatgtaatgaaaaccacaaatcttaaacaaaaagattaattttaacaaatgaatacattaatgtgaccatcaccctgatcgaggtaaagaatattccatgaccccagaaagttcccttgtgccctttccagtcactatcccatcctttaagtgaccattctcatatcatagatgaattttgcctattcctgcacttcatataaatgaaatcatagggtatatattcctttttgtgtcgcttctttcactcatcatcacagttttgagatccatacctgttgttgcatttatcagtagttcgttcattttagtactaaatagagcctgtatgactgtaccacagtttgtttatcgattacactgctgtggactttgttttttcccccaatttttagctattgtgaataaagttgttatgaactttcttgctcaagtttttttgtgaacatatgatttccagtctattggttatatacatatgagtagaattgctggattataggtgtaggtatgtttgagaaactgacgcagactttttcaaagtggctgcactattttaaacttccacctttcatgtatgacaggtccagttgcttcacatccttgacaacactttctattgacaatcagtgaatgtaatttgacgtttttccctttcttgtgaatgtgtagtgatatttgattatagttttaattagattttctatgatgacttgtaatgtaccttctccttgtttcttgggcatttgtatatctttatatatattatttttaaaattttatttttccataggttgttggggtacaggtggtacttggttacataagttctttaatagagatttgtgacaacctggtgcacccatcacccgagcagtatacactgcaccatatttgttgtcctttatcccttgcccccctgcacttttccccccaagtccccaaagtccgttgtataattcttacgcctttgcatcctcatagcttagttcccacatatcagtgagaacatacgatgtttggttttccattgctgagttacttcatttagaatactagtctctaatctcatccaggtcattattgttaattcattcctttttatggctgagtagtattccttcgtatatatatgccagagtttctttatccactcgttgattgatgggcatttgggttggttccacgattttgctattgtgaattgtgctactataaacatgtgtgtgcaagactctttttggaacaatgacttcttttcctctaggtagatacccagtagtgggattgcttgatcaaatggtagttatactttgagttctttaaggaatttccacactgttttccatactggctgtactagtttacattcccactagcagtgtagaagtgttccctaatcgccgcatccacgtcaacgtctactgttttttgattctttgattatggccatttttacaggactaaggtagtatcacattgtggttttgatttgcatttccctgctcattagtgatgttgagcattttttcatatgcttgttggccattcgtatatcttcttttgagaattttctattcacgtccttagcccacttttttatgggattgattttgttttgttttgttttgtgtgtttttcttttcttactgatttgtttgagttcattgtagattctggatattagtcctttgtcagatgtatagattgtgaagattttctcccactctgtggattgtctgtttactctgctgactgttccttttgccgtgcaaaagctctttagtttaattaagtcccagctatttatctttgtttttattgcaattgcttttgagtttttgttcatgaaatccttgcctaagccaatgtctataagggtttttccaatgttgtcttctggaatttttatagtttcaggtcttaggtttaagtccttaatccatcttgagctgatttttgtataaggtgagagatgaggatccagtttaattctcctacatttggctagccaattatcccaggaccatttgttgaatacggtgtcctttccccactttgtgtttttgtttgctttgtggaagatcagttggcttaagaatttggggtttatttctgggttctctattctgtttcattgatctatgtgcctatttttatatcagtaccacactgttttggtgactatggccttatactatagtttgaaatcaggtagtgtgatgcctccagatttgttctttttgcttagtcttgctttggctatgagggctcttttttggttccatatgaattttagaattgtgtttttctaactccgtgaagaatgatggtggtattttgatggggattgtgctgaatttataggttgcttttggcagtgtggtcattttcacaatattgattctacccgtccatgagcctgggatctgtttccatttgtttgtgtcatctatgatttcttttagcagtgttttgtagttttccttgcagaggtcttttgactcctttgttaggtatattcctaagtattttatttatttatttatttatttatttatttatttatttatttatttttgcagctattgtaaaaggggttgagttcttaatttgattctccacttggtcactgttggtgtatagaagagctactgttttgtgtatattaatcttggatctggaaactttcctgaattcttttatcagttctaggagctttctggaggtttctggagctttctagggttttcaaggtaatcaatcatatcgtcagcaaacagggacagtttgacgtcctctttaccaatgtcgacgccctttatctctttttctagtctgattgctctggctaagacttccagtactatgttgaagaggagtggtgagagcaggcattcttgtcttgttctcgttcgcagggggaatgctttcaacttttctccactcattattatattggctgtgggtttgtcataagtgcctttgttacattaaggtagttcccttgtatgccaattttgctgagggttttgatcataaagggatgctggattttgtcaaatgctttttctgcatctattgagatgatcatgtgatttttgcttttaattctgtttatgtggtgaatcacatttattgacttgtgtatgttaaaccatccctgtatctctggtatgaaacccacttggtcatggtggattatttttttgatatgtcattgtagtcggttagctagtactttgctaaggattttagcatctacattcatcaaggatatcagtctgtagctttcttttttggttgtatcctttcctggttttggtattagggtgatgctggctcatagaatgaattaggaagggttccttatttctctgtcttgtggaatagtgtcaaaaagattggtaccaattctttgaatgactggtagaattctgctgtgaatccatctggtcctggactttttttgttgttggtaattttttaattaccatttcaatcttgctgcttgttattggtcggttcagggtatctaattcttcttaatttaagctaggatggttgtatttttccaggaatttatttatctcttctaagttttctagtttatgtgtataaaggtgttcatagtagccttgaatgatcttttgtatttcagtggtatcagtcgtaatatctcctgtttcatttctcagtgaggttatttggatttctctcttcttttcttggctaatcttgctaatggtctatcaatcttatttatcttttcaaaggaccagctttttgtttcatttatctgttgtactttttttggttgttgttgttatttcaatttcatttagttctgctctgatcttggttatttcctttcttctgctgggtttgggttggtttgttcttctttctctagttccttgaggcgtgaccttagattgtctgtttgtgctctttcagactttttgatatatgcatttagggctgtgagcttttctcttagtatcaccttagctgtatcccataggttttgataggttgtgtcattattgccatccagtttgaataattttttgatttccatcttgatttcgtttttgactcaatgctcattcaagagtaggttatttaatttccatgtatttgcattgttttgagggttccttttggagttaatttccagtttaaatccactgtggtatgagagagtgcttgatataatttcaattttcttaaatttatcgagactcgttttatggcctatcatatggtctatcttggagaaagttccataggctgtttaatagaatctgtattctgttgttggatgaagtgttctgtatatatctgttaagtccatttgttccaaggtgtagtttaaatccattgtttctttgttaactttctttcttgatggcctgtctaatgctgtcagtggagtattaaagtctcccacttttattgtgttgctatctcatttcttaggtctattagtaatttttttaataaatttgggagctccagtgttaggtacatatatgtttgggattgtggtattttactgttagacaaggccttttaccattatataacgtccctctttgtctcgctgttgctttaaaatttgttttgtctgacataagagtagctacccctgcttgcttgtggtgtccatttgcatgaaatgcctttttccacccctttactttaagtttttatgagtccttatgtgttaagtgagtcacctgaaggcagcagatggttggtgagttcttatccattctgcagttttgtatcttttaagtggaacatttaggacatttacattcaatgttagtattgaaatgtgaggtagggttgcattcatcatgctctttgttgcctgcatactttgttttttgttcttgctttttaacttctatttttttataggtcctgtgtgctttacgctttaaagatattctgtcttgatgtgtttccaggatttgtttcaagatttagagctcctttttgaagttcttacagtggtggcttggtaatggcaagttctctctgcatttgtttgtctgaaaatgactatcttttcctcatatatgatgcttactttcactggatacaaaattcttggctgaagattgttttgtttgaggaggttgaatatagggccccaatcccttctaacttgtaaggtttctgctgagatttctgctgttaatctggtaggttttcctttataggttacctggtgcttctgtctcaccgctcttaagattttttccttcctcttaactttggataacctgatgaaaatgtgcctagatgaagatcttttgaggatgaatttccgaggtgttctttgtgcttcttgtatatgcatgtctaggtctctagcaaggccagggaagtttgccttgattattcccccaaatatgttttccaagcttttagaattgtcttcttcctcaagaacaccgattattcttgggtttggtcatttaacataatcccaaacttcttggaggctttgttcatattttcttgttcttttttctttgtctttgttggattgagttagtttgaagaccttgtcttcaagctctgaatttctttcctctacttgtttgattctattgctgagactttccagagcattatgcgtttctaaaagtgtgtccacagtttcctgaatttttattgtttttttctttaagctatctatattctttagtgcagtgtatattgaaatattttgccaatttttgttgtttattaaccttattattgttttgtagaattctttatattttccagatatgaggtctttgtcacatatatatattaaaatattttcttccatcctgtgactgctattgcacgttcttaatggtgtgttttgttgaacaaaggttttaaaatttgttgagacctaatttatcatttgttttgttttatggatattgcccttatgcgtatctaagaaaccttagcctacctcaaagccttgaagacattttcctattttctttcagaagctttataattccagcttccacactgatatctataatcattctcaacataatttgggagtatggtgtgagggaaggttaagtttcattttttcctccacaggaatatccagttgtttcagcaccatttattgcagacattcttatctccaattgaattgctttgaggactttattgagaatcaattgatggtatatgtgtcagtttatttctggactctatattttgttcaacttatttatttttctattatgctaataccacactgtcttagttaatgtatctttacattaattaagaattttgtgttgccttatggagtttagaataaatttatcaatttatataaaaattttactcagcatcataattttgaaaaaaaatttttctataaaaatcctgctaggtaattgtgttgaatttatcatcaaatttggggaaaattgatatcttaacattaagtcttacaatcacaaacatggtattatctttttatttagatctttcttaatttttcttagaaacttatgtagttttccatataacagtattgtgcatcttttgttaaatgtatttcaatgccatttactcctgatactgttgttattagtcttgttctttgaagtttcatttttcaatggttgtttctaataactaaaacacaattgatttttgtatattgaccttttatgctatattacttattagtgttggtattatattgtagatttatttgaattttcatgtacaaatacagttggccctgtgggttctgcctccatggattcaaccaactgcagatcaaaaatatttgaaaaacaaaaatgatggttttgtctgtactgagcacatgtagatattttttcttgtcattattcctgaagcaatatagtataacaactagttacatagcattcacattgtattaggtattacaaataaactagtgataacttaaagtatatggaaggatgtgcatatgttatatgcaaatagtatactattttaggtcagggacttgaccatctgtggattttggtatctgtgatgggtcctggaaccaactgcccatggatattgaggacgactgtatatataaaattatgaacttaatgtacaattataagtgtaattatggattttaaaaattttgtactttctaagtgtttattatttgaccaatataatcattttttagttttcaatatgttttcatacatttattttctttacttccccatttaaaatctcaagttgacaaataattgtatgtctttatggggtacagtatgacactttcatatatgcaacaattgtagaaatagaaaatcaagctaattaacgtattcatcacctcacttatttttaatgaggtgagaattttaaaatccacttttagcagtcaaaaaatatagaatacattattatcaactatggttatcatgttgtgcaatagatcactaaaatttattcttcctttctaactgaagctttgtatcctttggccaacatcttcacttttgctatccccccttcactctgtagcctctggtaaccaccattctattctgtgctccaatgaggctgacatttttagattttacatataagtgagatcatgcagcttttgtctttatgtggccagcttatttcacgtagtattatgtccttcaggttcattcatgttgtcataaatgacaggattttctcattttttttaaggttgaatagtatttcatcgtgtattgtatgaaactttttgtgaacttatgctttcatttctcttggacaaaaacaatatttcattgaattgttatcagttaacatactctgtaggatttcagtattttgactaatcttgagaattactttttggcccagtaatattctttcatatttgatatgccataattctaaaaaataatgtatatcttgtagctgctagtgtactattttataaattccagtaagttcaaatttgctgagagtgttgatcactatagtgtttctgttactgttttcttttgatcagttcttctatcatttcctgagaaagacatactaaaatttgcacttcggcctgtggattttttctctctaattttgtcaaattttgcattttctattttgaagctctgttattcatcacatttgattattttgtcgtcttcatgaattaaatattttattattatgaaatcactttttatatatctagcaataaataagtctgttaagactttgttttgaagcctgctctctttgatatccatgtagcaaatccagacttttaaaaatagtctttattttttagagaagttttagggtcacagtaatattgagcagaaggtacggagttcctatataccctctgcctcctcacatgcaaaactttcttgattatcaacatctgccatctaagtgataccttccttacaattgataaacctacattgacacatcattatcacctcaagtccataatttacgttaggatttactctgtgtgtttttgtttgtttgtttgcttgtttacaggatctggctctgtcacccaggctggagtgcagtggcaagatctcggctcactgcagcatctgcttcccaggatcaagtgatcctcccagctcagcctcctgagtatctgagactacaggtacgggccaccgtgcccggctcatttttgtggatatggggttttgccatgtttctcagactggtcttgaactcctgggctcaagcaatccaccagcgtcagcctcccaaagtgctgtgagccactgtacccagacaggatttactcttgatattgtgcattctatgaatttggacagaaatgtgtaatgctatgtatccaccattatggtattatacagagtagttgcactgctctaaaattcctctgttctctgcctgtaactcttccctctccccagtccctgtgtattagctcatttatttttccagctttattgaggtataaatgacaaaaattatatatgtttaaatttcaccatgtgatgttttgatatatgtatacattgtgaaatgattaccacaataaagctaattaacgtatccattagctcacatagttacaatttttttgaggtgaaaatatttaaagtctactctcagttaattttgagtacatatatagtactattaactacagtcaccatgccatacattagatccccagaacttgttcatcttgcataactgaaactttgtactctttgaccaatgtcgccccattttccctcacccgtatcctggcaaccaccatccttctgtctggttctacgagtttgactttttagattccacacgtaagtgacatcaggcagtatgtgtctttttgtccctaggttatttcatttaacataacgtcctccaggttcatacatgttgttgcaatcgagaggattttctttttaaaaaactgaatagtgccattatatatgtgtgtgtatatatacatatacaatatatacacatgtgtatataatatataatcatatataaatgaacactatatatatgtacaccacattttctttattcatccattgatggacactcagtttgcttccatatattggctattgttaataattctcaaatgaacataagaatgaagacatctcttccagattctgatttcatttcctttggttatatacccagaggtgggactactggatcatatagtagttctatttttagcttttcaggaactccatactgtattccacaatgaaactgcccatttacattctcatcaacagtgtacaagggtgcccttttctccacacctttaccaactcttttttttttgtcattgtgataattgccatcctaacaggtgtggtgatatcttattgtggttttgatttgcatttccctgataattggtggtgttgaacatactttattacacctattggcaatttgtatgtgtttttttgagaaatgtcctttgcccatttttaattatgttatttgttttcttgctattgagttgtttaaattcctaatacattttaaatattaaccccatctcagaaatgtggtttaaaaacattttcttccattccatagtctttttattctgctgataatttgatttgctatgcagaagctttttttatttcatgtagcctcatttgtctattttcgcttttgggttgtgtccttttgaggtaatatccaagagagtattgcctggaacactgtcaagaaaattttttcctatgttttcttctaggaatattacagtttcgggtattacatttaagtctatattctattttgagtctatttttgcatatggtgtaagataagtgtccaattttattcttctacaagtggaggtccagttttccaagcaccatttattgaagagaatatcctttccccattgtgtgttcttggctgctttgtcaaagatcaattgactataaatgtgcagatttatcgctgatctctctattctgttcctttggtctatttgtctacttttaggccagtaccattctgttttgattactatagctttttggtatgttttgaaatcaggtagtgtgatgactccagttttgttcttcttcctcaagattgctttggctattcagggtcttttgtgcttttatacaaattttaggatttttttctatttctttaaaaaaaaggcattggaattttgataggaattgcattgaatctgtagatcactttgaatgtatggaaaattttaaaatattaattcttccaaataatgagcatgtgatatatttccatttattttgtcttctttaattttttcatcaatgtttgataattttcagtgtccagatatttcacctccttagttaaatttacacctaagtattttttttgctattataaatgggattattttcttaatttctttttcagatagtttgttgttactctgtagaactattaactgctttttcctgttgaatttgtttcctgcaactttactacattggcttattagttctcatcagtgggcctggagcctggggccatggaggcaggtctggcactggagtgtgcctggagcctaggttgtggagatctttctggagactgggtacatgtggcagtcgggagggcctgaagtctgggtttgtaagggttgacctggtgcccaggaacactggggtggtcctggtgctggggtctgcagtgaagtcatgtgctcacttcagtctccttcccacatattgagggtatatccaaactgcactatacacacatggggaaggggtgatggagtaatgtaaaactgttcttattaccctcatctatgcatcttttcttatttctgtgctccacccaggttctgtaatctatcatttggattccttaggatttataaagatattttcatgtatgtattgttattcaaattgatgttctgagaggggataagtgctgaaaggtagtctgccgtcttgctgactttacgcttcctcagcgtttttatgcttattgctggcatagtatttttttcaacccttttacttccaacctacctgtcttaaatataaagtgcaaatagatagcatatagtttggtcttgcattttttattccatattgataatttatatcctttagttggagtatttgatagatttacatttaatataattattgatatggttggatcatttactcagatctatcatttaatattcattttctatttggagaatcaatttcttgtttccttttactcttttcctgtgttaacttgggttaattagatattgttttagaattgcattttaatttatctattgcttccagccagctcactttgcattattttttagtgactgctccagtgattctacaggtatccttaaatttacttccttctttttggtgggtgagaggtaggtaagaacatttaacatgagatctacccactcaacaaaatttttaagtgcacaatacagtgttgttaactataggcactatgttgtatagcagatctcttgaacttatttatcttgcagaactgaaacttcatacccagtgaactaccaattttccctttccccccaggccctggcaaacatcattttactctctccttctgatacgtacccaaagatgggattactggatcgtatggtagttctatttctaatttttgaggaatttccctagtgtattccacaatgaccgtaccaatttacattcccaccaacaatgctcaagggcacccaacactttttatctttttttgttttggtaatagccttcctaacagatttgatgtgatatctcattgtggttttgattggtatttctctgatgattagaggtgttgaccatttttaatttaattttattttattttattttgttttatttattatacttaaagttctgggatacatgtgcagaacgtgcaggtttgtcacataggtatatatgtgccattgtggtttgctgcacccattcaacccatcatctacattaggtatttctcctaatgctatctctcccctcgccccccacttaccgacaggccctggtgcatgatgttcccctccctgcatccatgtgttctcattgttcagctcccacttatgagtgagagcatgcagtgtttggttttctgttcctgtgttagtttgctgagagtgatggtttccagcttcatccatgtccctgcaaaggacatgaactcatcctttttaatggctgcatagtattccatggtgtatatgtgccacattttctttatccagtctatcattgatgggcatttgggttggtaccaagtctttgctattgtgaacagtgctgcaataaacatacgtgtgcatgtgtctttatagtagaatgattataatcctttgggtatatacccagtaatgggattgctgggtcaaatggtatttctggttctagatccttgaggaatcaccatttttaaatacacctgttatacatttgtatatcttcttttgagaaatgtctattcaggttttttgcccatttttaaattgggtcattttcttgctactcagttgtttgagttccttatatatttcagatattaaccctttatccaatgtatggtttgcaactgtatttcctatttccattctgtaagttgtctctttactctgttaattgttttcctttctgtgaagaagcttttcagttttatgtagtcccacctatgtatttttgcttcagttacctatacttttggtgtcatatccaagaaatcattgccaagaacaaagtcaaaagcttttcctccatgttttcttttaggagttttgcagtttccgatattatgattaaaactttaatccagtttgagttaatttttgtgtatggtataagagtccaattttatcttgttgcatgtggatatccactttttccaatgctagttgttaaagggactatttttccccattgtgtatttttgccactattgtagaagatcacttgagcatatatgtgtgggttaaggttaggtgctctattttgttccattggtctacatgcctgcatttatgctaataccgtactgttttaattaatgcagctttgtattacagcttgaaataatgaagtgtgatgacttttgttttgttcttcttgctcatgagtattttgtctacttggggtctttatggtgccgtgtaagttttagaagtgttttttctatttctgaaaaaaaatgaaattttcatggggatagtattgaatctgtagattgctttggtggtatggacatattatcaatattaattattccaaatgatgaactcaacatgtctttacatttacatgtgtcatccttattttttatcagtgtcttatacttttcatcatacaaatctttctcctccctagttatgtttattctcaagtattgaagttttagatgctattgtaaatgggattgttttattaatttcattttaggttaatttattgttaatgtatagaaatgcaagtaatttttgtatatagattttgtatcctgccactttactgaattcatgtattatttccaacagtttttttgtttttggtccttaaattttctatatgtcatctgcaaacagagataattttacttcttacttcttgattggatgtattttatttctttttcttgtctaattttcctgactaggggttctagtcctgtgacatgtggaagtgggaagaagggtaaaccttgtgttattgctcatcttaaaggaaaagctttcagtttttcaccattgagtatgatgttagctgtgggcttatcatatatgaccttatttattttgaggtatattccttgtatacctaattagttgagagaaaccatcattctcagcaaactaatacaggaacagaaaaccaatcatcacatgttctcactcataagtgggagtttaacaatgagaacacatggacacagggaggggaacatcacacatccgggcctctcagggggtgggggactaggggagggatagcattgggagaaatacctaatgtagatgacgggttgatgggtgcagcaaaccaccatggcacgtgtatacctatgtaacaaatctgcacgttctgcacatgtatcccagaacttaaagtatactaataataaaaaagttgtgttgaattttatcaaactttttgcatctgttgaaacaatcgtgatttttatcttttattctgttaatatggtgtatcacatttagtaatttccatatattgagccagctttttatctcaaaaataaataatacttggtcatgctgtatgatcctttttaattttttttttaagttctggggtatatgtgcaggatgtgctggcttgttacataggtaaacatatgccatggtggtttgctgcacctatcaacccatcacctagatattaagcccagcatgcatgagatcttttccctaatgctctccccacccccaccctcccctgacaggctccagtgtgtgttgttcccctccctgtgtccatgtgttctcattgttcaaatcccacttataagtgagaccatgcagtgtttggttttctgtttctgtgttagtttgctgaggataatggcttccagcatcatccatgtccctgcaaaggacatgatctcattcctttttatggctgcatagtactccatggtgtatacgtaccacattttctttatccagtctatcactgatgggcatttgggatgattccatgtctttgctattgtgagtagtgctgcaatgaacatacatgtgcatatatgtttataacagaatgatttatattcctttgggtatatacccagtaatgggattgctgggttaaatggttttctgcctctagatctttgaggattcatcacactgtctcccacaatggatggaccaatttacattctcaccatcagtgtaaaagtgttgctatttctccataaccttgccagcacctgttgtttcttgactttttaacaatcatcattctgactggcgtgggatagtatctcattgtggttttgatttgaatttctctaatgaccaatgatgttgagctttttttcatatgtttgttggcagcctgtatgtctttctttgaaaagtgtctgttcatgtactttgcccactttttaacgggcaaagattttatgatgaaatcgccaaaagcaattgcaacaaaagcaaaaattgacgaatgggatttaattaaactaaagagcttctgcatagcaaaagaaactatcataagagtgaacagacaacctaaagaatgggagaaaatttttgcaatctatccatctgacaaaggtctaatatccagaatgtacaaggaacttaaacaaatttgtgtgtgtgtgtgtatatatatatatatatatatatatttttttttttttttgagattgattctcactctgtcacccaggctggagtgcagtggtgtaatctcagctcactgcactctccacctccagggttcaagcaagtctcctgtctcagcatcctgagtagctgggactacagtcgcacaccaccatgcctggctgatttatgtatttttagtagagatggggtttcaccatattggtcaggctggccttgaactcctgacctcaggtgatccacctgccttggcctcccaaagtgctgggattacaggcctgagtcaccgtgcccagcctgtatgatccttttaatgtgctgtttaattcaggttctcatattttgttgaagattttcacatctatattcatcaggggtcatttcctataattttcttttcttgtagtgttcttttgtggctttggtatcagggcactactggccttgtaaaagcagtttggaagtatttcctctgctttttggaacagtctgagaaggattagtattaattctttaagtatttggtagaattctggccgggtgctgtggctcacgcctgtaatcccagcactttgggaggctgagacgggcagaccacgaggtcaggagatctagaccatcctggctacacggtgaaaccccatctctgctaaaaaaaatacaaaagattagccgggcgtggtggcacacgcctgtagtcccagctacttgggaggctgaggcaggagaatcgcttgatcctcaggaggtggaggttgcagtgagccgagattgcaccactgcactcaagcctgggtgacagagtgacactctgtctcaaaaaagaaaaaaatgtatatatatacacacacacacacatatacacacacacatatatacgtatatatgtatatttggtagaattcatcagtgaagccatcaggtcctgggctttactgtgttggattgtttttgataactaattcaatcctcttgttaattttctgttcatgttttctatttctttatgattcagttttagtacatgttatggttctaggaaattagtcatttctcctaggttgttctatttattggtgtataattgttcatagtagtctcttctgagcctttgtatttctgtgatactatttgtaatgtctcctcctttattttctctttgtttcttagttatttcagttaatgttttgtcgatttcattgatcttttcaaaaagatgcaactgttagtttcactgattttttaaattttgtttttctattttcttcatttaattttgccccaatctttattatttctaaagttagattgtttatttatgatctttttttttctttttaaatgtaagcgtttattgctattcacttttctgttagtactgcttttgctgcatcagatctcatgagctttattcactattacgagaatagcacaggaaagactggcccccatgtttctgaggcctccccagccatgaggaactgtaagtccaattaaacccctttttcttcccagtctcgggtatgtctttatcagcagcatgaaaacggactaatacaatagggatgaacttactattgccattttattattgttttctatcttgttttattattgttccttttgtttattcttcttgtcggttttttaaattgattttttaaaatagtgatatccttagattctcttctctttttcttttgtgtgttttcaatagatacttttatttgaggttatcatgaggttcacataaaatatcctccggttataatggttcattttatgctgataacaacttaacagcaattgcatacaaaactctgcattttgaattctcccctccccactttatgtcattgatatcacagtttacatcttttgtattgtgtagccactaactcacttttgtatttattatttttattttaaaaatagttaaaatttttaattatttttatttttaaaataaaacaaaataaaaataataaaaaataaaaatacttttattttttaacttttataccaaaagtgatttaaacccaatcattacaatattgcagtattctgtatctttctaaatattcaggcttgccagtgagttttagacttttatacgcttttgtgttgctgcttagcatcttttcattgcaacttgagaaactccctttaacatttcttataagacaggtctagtgcttatggagtccctcagcttttgtttgttatctctccttcaatgtttttccaaatgttttattgtgataaaatatacatattatataacttaccatcttaaccatttttaagtgtacagttcagtggtattacatgcatttataatgttgtgcaaccatcaccaccatctagttccatcattcttttcatcttgtaaaatggaaacttcatacaccgtaaacagtaagtccccattccttcctgctcctagcctctggcaaccaccataagacactagttcctaaggcagtgaaatgacagacctgaaatattagatgcgtgctccactctccctttctcctgagagagaaatcatgggccaagatgatctcacttggtgccaaattttgctggtttgggggaaggaatgacacaggtaaaatgaaattgctcttttttactgtttcagtgggcctgttctagtgttttgtgctcatctggggtattcaacatcttaactggattctggacatctcttggaggtattttgattaatatatttttgttaaataggtgtttctgtaaggaaatgagggttggggctggggcttattattccatcttgctcctccatgcatctccactccactcctccatgcatctttatcttttcaaagtatactacaatttaatattgtattgcctcacataaaatttaaggaccttgtcaatgtctagtttggtttgccgctatgccctctttcatattatagttttcatgcacatcatgtctatgtatactacacactgcacattataatgttatgatttttcttttgtattctcatatgtatatcaaataaagagcaaaatattattttatgtttatccacatattaccattcctgatgctatttattccttcctaaagatccagcttttcatctggtatcactttccttcagactcaacaatttcctttagtatttcttatcgtatgaacatgctgataacaaattgtcctaatgttcacttaaatgaaaatgtcagtatttgcctttattaataagggatatttttgataaatgtaaaattctgtattgatagagtttttaaaaaattcagcactttaaagatgtctttttttcttatgaaaggtcacaggttggccgggtgcggtggctcacgcctgtaatccctgcactttggaaggccgagacgggcggatcacgaagtcaggagactgagaccatcctggctaacacggtgaagccccgtctctactaaaaatacaaaaaactaaccgggcgtggtggcgggcgcctgtagtcccagctactctggaggctgaggcgggagaatggcgtgaacccgggaggcggagattgcacaatgagccaagatggcgccactgcactccagcctgggagacagagcgagactccgtctcagaaaaaagaaagaaagaaagaaaggtcacaggtcagttttattctgttcctcagtaggcattttttctccctaatgctttcaaagttttctatttaaatttgtttttcaatagtttgactatgatatgcctgagtgtggtatcctgcttggaatttattgagcttgttgaatctgtaaatgtatgtgttttattatatttgtttttttttcaaacagctttattgagttatagttgatatacacaaacctgcacatatttaatatattcaatttgatggtttttcatcatatttgcaaatatacagccattctttttaaaataatttttatttttgtgggtatgtagtaggtatatttatgggtacatgagatgttttgatacaggcatgcaatgcataataatcatatcatacaaaatgaggtattcatcccctcaagcatttatcctttgtctcacaaataatccgattatactattttagtcatttctagatgtataattaaattgttattgattatagcctccctgttgtgctattatatactaggccttattcattcattctattttttctacccattaaccatccctccccactacccttcccagcctctggtaatcatccttctacactgtatctccatgggttcaattctttgattttcagctcccacaaataagtgagaatatgcaaagtttatcttctgtgcctggcttatttcacttaacacaatgacctccagtttaatccatgtttttgcaaattacaggatctcattcttttttatgcctgaatagtattccattgtgtatatgtaccacattttctttatctattcatttgctgatgaacacttaggtaccttctaaatctatgctactgtgaatagtgctgcagtaccagggagtgaagatatctctttgatatactgatatccttccttttgggtataaacctagcagtgagattgctggataccatatgaggtagctgtatttttagttttttgaggaacctccaaaccgttttccatagtggttgtactaatttacattcccaccaacagtgtacaaagattcccttttctccacatccttgcctgcatttgttattgcctatcctttggatataggccattttaactgaggtgagattgtatctcattgtagttttgatttgcatttccctgatgactagtgttgttctgcaccttttcatatgcctgtttgccatttgtatgttttattgtgagaaaagtctatccagtttttttttgcccatttttgaatcagatttttagatttttttctatagagttgtgttagctccttatatattctagttactaatcccttatcagatgggtagtttacaaatattttctcccattctgtgggttgtcctttcacattattgattgcttccttttctgggcaaaagctttgtaatttgatgtgatcccatttgtccatttttgctttgatttcctgtgcttgtggagtctttaggtttttccaaatataagatcatgtctgcaaggaaagataatttgacttcctcctttccaatgtggatgccctttatatctttcttttgtctgattgctctagctaagtcatccagtactatgttgaataacagtggtgaatgtgagcatccttgttgtgtcccagatcttagaggaaaggctttcagtttttccccattcagtatcatattagctgtgggtctgctgtatatggtttttattatgttgaggtatgttccttctacacccagtttttaagatttttgtcatgaagggatgttgaattttatcaaatgttttctcagcatctattgaaatgatcatatgatttttgttcttcattctgttgatatgatgtatccctttgattgatttgtgtatgttgaaccatccttgcatcccagggataaatcccacttggtcatgatgaatgatctttttagtgtattgctgaatttggtttgctaatgttttgttgaggatttttccatcaataattatcagggatattgtcttgtggttaggcttttgtttcaaatgttttttcttcctcttctcttattgtttgccatctgggactccaattatgtttataactttgatattatcctatgtatttctaacactctgctcatcctcttcaatctttctctctctaatctgtacttcagattagataatatcactagatttttcttccagtgaaactactctttcttctgccattttcaacctgccattaaacaccaactcactgaattttacttcagatattctgacttcctatttgttcatttattacacatgtgtttttctttatttcccttagtgtaattatgatatgtgatttaaaattctttctcctaattcaaacatctggtttaccttagggctggtctctattattattttttccttggatatgagtaatattttcctatatctttgctttggtagtaatttttgagtgtaccctgaaaatagtgaattatatattgtaggatacctttatttttttctctagagcattgattttgtttgttttagtagacagttaatggggctgaagtgaaactccaaactctccctcattggcagcactgaaaactctgtttaattctttcagctttatttaggctttttggaatctgttcccacataaatatttcatggtttcaccagacagctgggtagtttatacacagaatttggggcttcctctccctagttttttaaattattgaatttctctcatggcttttcaactaccgtggtcatcctgaattctgccgtctggttctttcagacacttggactgtgagcagttgtgtgtgggagctggctaacactggtttgtgaatgcctactgtgcatatctctattcaactccatgttcatggaatggtccgtggtagaagtatttacaccattgaaattggcaaatactatgaatttgttttttattaattttcctcaagatccagttgttaaacatttaacagttgcaacattgattctagtttctctagagtttattcactgctttggcctgggggctgccatcagacaaaaatttccagaaaaggaaaaactcacttagtattgttccctcctttcaattattaattccctttcaatttttgcctgtttatgggttgctttcctgtgcatttaaattgttttattatatatttggtccactgtttattattgttatctgcatcagggttggtctgatagaagcttcttcaccattgccagaagttttcctaataaaggattctgttttttttgttgttgttgttgtttgtttgtttttggtttgcagtcaagtgggaaaattatgaaaatgctgtgaagttttcatacaggtataattgtatgattcagagaagagtttttttgttcagagagtgtcttaatccaacttatttatattaaaatatcttttctttaaaataaatggtggcacccagatggtttatttgtttgtttggtatctttattagatgaaaagttttcaattgtagtagactgaatagtgtcccccaaaattcatgttcgtctataacctcagggtgtgacctcatttcaatggtatggtatttgcaaaaggaagtagttaaagatcttgagatgaaatcattccggatttaggttgggccttaaatccaatgactggtgtctttataagaaaaaagagggagatttgggcacacagaaatcagaggagaagaccatttgaagaccgaggcagagattcagtgataagccaaggaacactggaaaccaccagaagctggaagagacaagaaatcattctctagaacttttggagtagtttgaccctgccagcatctcgattttagacttctgaccttcagaactgtgagacaataaatttctgttgttttaagctactgaatttatggtaatttgttatggcagccctagaaaactaatacagcaaccttaatatttctttttgccagtatactaatctattaaatccaatggacatttatgcaaacaaatctacacatgaaaatgggtacctatgcaggaaaaagtatttatagctttatgctcacatacacacttgctttatgtgcaagttacatgttaattttgtagagaaaaatactgtacctgcagtcagcaatctgagtactggccttgattctgccactgactcactatgaccttgtgtgaattatattttctatttagtctagtttctttttctgtacaatgacatggttatctttatgggtccctttagctcagtgactctaagcttacgagtacctatctatcttctactcaatgtatggacacatgcttttgaagatgtataggagtgtagcacatgtacttcatttggcaggagtagagagcattagaaatttgggggaaaaaaaccaacaggatggtagtttaaagagaaatggcacactatgggcaacattgtaaatgcctattatgtcccagtcactgtatgtatattgacactagtatacttaaacacactatataactcactttcaattagatgccctctgaatttttctaacaggactagaaatcacaatatgaagagtttgactaagaaaacttttatactaatcattatatgtaagcagatgctgaattctttgataggaacagctctttattcacgtgcttatattggtattatccctgaaacacaaaagatggaatgttgaatcaatgtgatttggagtcgcatttggggactcacctttggagaacttttgaaatgtggcagtttagtttttattttctaagggccaacttctcctttacctggaattttcctgtctttagattcctagactgttagttctggaagggtcttttaagatcatctatttccattaccattcatttggtcactgaggatattgagggccagattgaagaactcgttgaaagcaacacagcaattttcagaggcagaactcaaactcaagttcctttattttatttttagcctaggtctttttccactctatgctgcattgttactgtgctttgcctaggttgctttttttcttttgacccaatgggaatatagttcttttatactttgagtcaataattatccttctccccaccttagtccttgtgcaactcatgtataggctcacacaattacatacatctatattccctttggaatttttgaaaagaaagcattgtggttctgctgcttgtctgtcttacctacagggaagctagaactgatagttttgaattgggtctgcacttctacttggttgagggtgggggtggaagttaggtcaacaggggatcaatgtggcggaactctttcttcttagtggagtatgaatgacaacccctttgatgtacatttttctagctcattattgtccccagagatggaatctgaacagacaggattgtcaaacctttatttgcagcctgggttagaaggcacgcccataaggatataagggagacagagggaaaaaggaggaagctcactcttcagtctcggagcagcaagtaagcatcacacatcagctacagtaacccatacttcctttatcctcctattcgctcatacccttttgctctctttctcttccctttgctgcctctgctcctccctttctctctgggcttccctctatttctctgttggatgccttaaggaataaaatactactttagtatttcgtaaaacaaccacatctaaagccttgcagtactgtattcagagccccagcacagccgcgtgctaagcaccagtggtgaacctaaagccagcaaagggggaggggagaaggggaggggaggaggggagggagaaactgacagagagggagggaggcagattgagagagagagagagagagagagagagagagagagagagcgagagagcgtgagcgcgcgcaagctagcgagcaaaccagagagacagaccgagagagggaccaggagagagacccagagagagaagaagaagccagaagccgagctctgtcagggctcaacctccaacttgtttcagttcattcatccttctctcctttccgctcagactgtagagctcggtaagaaacattgatgttccttcttccccctcccccaagctcaggtctcctttagcgatagcatctctcccccgtactgagagtctccttgggttggccgggaggcgaggcatgctctgcagctgtgatgctatcctgggttccccagtggggctggtggaagcccagaggcggcatctgagcagggagacactggggtaaaacccgatttgaggaaggggggttgcgatgtggtatatgcgtgatttgcttcattgtcagtgaattgttttgttcctctttggaagcaggtcagcactgaccttgcaaattgcttggggggccccagcagctgctgcagaaagccacggagtggcccctagccaaagcagacagcactgtcatgaccccccagacagctctaggcaccagggatgtagtaatggctggagctttctcccttctttaactctttctccgcagctgcttctcactgctggaaataagaaagaaggagggtaccttgcagcctctttccccatctccccattacctcccccacatgcaagtgagtagaaagttgtaaataactgcttcctttaaagcagattgagccctccccccttcctttgaggggctcactgtggggttgggcctgacttcctccacaaacttgggaggtttgccttgtttcccggcgagaagctccattgcctgcccaccctcaattccagataattgagctgacatcctagatcagagattgagataccccaccccatctcactcataggcatcatgttaagtccagctgtgtccttggaagggaggaaacacctgatggtttgtctgcaactggcctcccagtttgttgctcctctgactgtggctgtggctgtggctgcgggtggcatgggcaagaggactgggggaagggtggctgttggatttatggaaagcagggtgatgaggtaggattactaacgtgagtagtttggcttattgagagtcagcaagttctggttgtctggagctctgcaaagactgattgaggctcttgtagtatagcccttcagaactggtaggggaagggatccaattgtttgatgggagctttctaagtgagtgacgctgctgtgcctgtggtagtaattctgacatccctaatactaattgctaaaattatcgagtatgtagtatattttggattctgggctgagtgtttggtgtgtattacttcattaaattactgtagcagaatagtgcattgaataacagacactattattatctttggtttactcacaaaattgaggcacagagaggttaagtaacttatccaagattacagagcaattacatgtctcagttggaaattaaactggcaacctggttccagaatccgtggtcttaaccatgaagcactactgccttcttggggagaattttgcacctttgtctgttaggcaagtgtagatacaataggtacagtgtggcttggcaaggttttttggaaagtagcggcctggctttcgtgtagagtaacagcaactcagcctggagccgggcttcacctggatttctggaggggctgcccaaaagactttgattggtcagcttcctttccttgaaaatcgtacttcactttttatagcctcatccacccaacatgctccaaactgcaccttttaaaaacagacctcattcttatttcctgagcatttggagttgttctgtgccgaaaattttagaatactaaaaccttggaactggaaggagcccaaaaggtcattcattaagctttatttctctactcagttcttgaatttatcctaagcatccaatttgttgactgatttctagttgaactccctgcagtgacagagagtgcattaggtggctctttgtgtcatggagcaactctgattgtcagaaagtattccccatcataagccaaagtctgtttcccagtaacttatattcgttggttctttgggactatctggaacaaatttgctttttcttaataatagttcttcagttagttgaagacagcaatcatgcctccctcttaacccttggatccaataagaccacagagtaaaggattatcatttacttcatgctggatattagactattcttaatatggcctaatagcccacttgttttgttagccacaaattgaccctacggagttttctagagcagccctgatagtgtatattctcttccttggatgagcttgctatctggtgtcaactggactgatgggagcaaggaaggtcgctttcatattcctaaagaccagaaattggttagtactagtccttctaaagcccccaggatgtctatatggcatccggacaataggcgtgtgggaagatttgagtggcaggaattttcataaagaaaattatgaaattttctaatttcatgaagaaaagtaccacatttgaaatagtggtagttcaaggttcatacagtatgcagaaggtagaagaatatattgttttatcagaaaacacctcaggaataattacatcactgaggggatacaatgcagtgggactgggtggaaaggggtgagtatgtggttgctagaatggaacactgacttggctgttagcaaatttgggttccattcctagctcagatgatttgctgattatcttggacatatgacttcccctccatgtgcctcagtttttccatctgtaagatgttgagatggactgtgtctctgagggtctttcaactctgaaattctctatctgaagtaaattataagatttcagagttatgagaggcttcggaaatcgttaggccagtgcttctcaaactttaatgtgtaaaaatatctcctgggaatcttgttaaaatgcgaattgtgattcagagagtctatggcaggggcctcggattttgcattttagcaatctattaggtgatcctgaaactgctgttccactgaccacacttcaagtagcaaagctctagtagagtactggtcaaactcccctagtgaaggaaaatgtttgttgtcatttgtttgtttgtttcctaatccatcacagaagactgttaatttagtaaaataaattaaccatgaattactagaaaatgaaagaaaagacatacaaaagataagcccgcatttgtattattagattctacagacataaaatgattttttcaaattgctgtaacattttctaagtgcttactcttgacttctgtactttggtccttactgcctggtaataaaagttcacagacaggcactgatttggcgggctacattttgagtgcactggtctaggctacctgcccatctaatttaagaggcccaaattagacccagctttaatttctaaatcacctgtcatgatcttttaccctacagttaaatatctcctttaatgaagaatttaacatttacacaaagttgcattgttcatgtgttgtgacagataaaatgtttgttttttcttaaaactcttaatttccttagagtttctacaaattacgctttcagttatatattccaagtgggtgaagggctgtatcagttcagttaattataccgttagccattagcctagtatatgacatagagtaggaggcttaacagatgttttttaaataaatgaatgaaccatttgacattagttgtggggccatacattcaataaaggaaaggtaatttgggctttcttctgcattggggaaacaggattcatcccattttaaaaatttcttacagtggatagaaagccaacttgactacttcagagggttacttggtatctcaattttattttgaagggattgctggagtgggccattataaggctgttggtctttattctagaaagagtgggactgattaaagggctttgagcaggataactgacatggcttaaatggaatctattcaatataaggttactaagtgcctatgatgaaccaaagataatgtgggagatacaggattatttaagaatagcctctgccctccaagatgacacagtcaagtaggaaagagaagaaatagacaaacaactatagtattaggagatgagatctacacccataagagagaagcaaagggctttaaggagatcaaagacaccttcctggaagtggcatttgaaatgagctttgaagatgagacaaactttgagtgtgcagaattgggggatgggaaaggtattctattcagaggctagttgtgttggagtaaagtgtatgcagaaatacttatgtgggatgtgtttggcaagatagatggagggcttgactgtcaatcatactgaatgctagatgggaaaattaggactttatatgcaaaggagatgcaactccctcattttgtggatgagcaaacccatcttgacagggtgagggacttgatttgcctgaggccacacaggtagtaatattgttgtagcccagtaaaaggtactgagcacatttgaaaatatgggattggaactctggaaagaagtcagtaggagagagtgatttgagagtcattgcctctcaatacttgaaatagaataaaagagattcaggggtggtactttgaagaatgctttttttttttttaggatatgggagagaacaatgaaccttatgtgaaggctacaaaggagaaaaagtcagggatatggaaggaaaattagaagagtacagtgttatgaaggtgccaagagaggagaggcaccttctaatttatttcttgcatacataacatttactaggcatggagaatataatggtgagcaaaacagacaaagttgttgccatcctgggctcatggtttagatggtgagatagacattattcgacagaccactgaactatgtagtcataaattgtgattcatatgtagaggaaaatgtaccgctttaaaaagaaaggtgtggtcagcattattaaacttcacagcagagttgagtagtgatagatgatatctggtttataacagtccttcccactctgatggtcacagtgcctaccaacacttcagttggatgatgcatacgcattttgcaaatgtttggcagatgactgtgcttcaatagtaagggaagggaagggtccctccaggctcatgtccacaggagcagtgacttacttaaaaactaggttatatgtcatgtagcttaactgaaattcacaaagacccagtgcctttcccaggtcctccaactctctctattcagcaatttataggaagaggcacttgataaaaaatatgaagaatttgatattaaaaatccctcttaaaatgggatttctgatagcctagtcctgacttggatactcggtttgttgtgacatatcacttgtcttgttggagcctgtttccataactgtaaaatacggtggggggaggtttggaaaagggttttgaatagggtgactgacatgaatccattaagatatttagaaagagcctccaagctgtaaggttctatagttcatgttctgctctatattgtgttatcatggttctgtgcaggtagctcaggtttggtcacttctataagcaacactaataactttatacagaattctgaaggttgataattttggtgggagtattcacagactttggaaggggtcattgaaatgcaccttccattttttattcctgaggtgactgaaattgtaactgtcctgagagttaaggaaagaactgaccgtattgtaaaatatatagtaaagttggatattaggtggtatttctattactgctggtttgaaataaactaaagtcactgagaataagatggggcataatactgttaaatacacacaaggtgattatctcattctgaaatgtaatggtccaggtagtctcttcctggggggaagatgtatgtgaagggaaatactagttggtaatataaaagcatttttatacttaaaagcatgattttaaacgtattgatgtctgcacaaaatatgtctcctgaatatacacagaagggggaataaaaatctccaggatatatattttgaagggtacttttctctttaaaaactgatttcttaaaaaacacaagtatttttttttttttttttttttttttttgagacggagtctcactctgttgcccaggctggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaaaaaacaaacaaacaaacaaaaaaaaacaaaaaaaaaaaaacacacaagtattatatatagtttttaagggaaggggaggtggatggagatggaattatgtaagtgaccatagcataaaataacctttcaaaatagtaaaagaggagttcagaaatggcagggcccttaacaatcatgtgatggcagtcttatcacccagtacatatggtcatctgttttcagtgtgaatggtttcaggaaaggttgcttaacaccaccagataacagacagcttggttgttagcaagttattcttcatactgacctgcaatctgtcttctgaattcaacctattgatcttgcaccttggagcaatagctatactgtgtaattgctgttccccttccttgtagtggccattcaaatgtttaaccatggttgttcttctcatcttttcttcagtctatatattgctagttcttgagcttatgtgatatatattttgagaaacttatacagtagacacttctatcttcagtgtccctcttaatatatgatgtccaaaacgggacccagtactttaagcatggatggctagcacttccatttaaaaaattgagtatattttctaatataccttaagattgtaatatctaccattacattgttttttcctgattataaaagtaaaacaaccgcattacagaaaattttgaaaatgaagagacatttaaaaaaaaaatcacctctaaatccctagtccagagataccttgctgtatttcctttcagatgtgtttctgtgtttatataatcgggatcacatcttatatgtactatttttgatctggctttttcattggtattatattgtgagcatttccccacatcggtcagcagccttcaaacaatttttaatggctgcatacttttcagttttcaatttctaccataattgtatgacagatcacatattgatcgtttaaattatttttgcttctttgaacctcaccttttttaggtctttattcaaatgtcacatttgaattctaaatgatctcacataaaaatgcaaacccatcttttccaacactcactcttcccctttcttgctttacttttttaaacctttggtttgtgtcatcacctgatagactagatacattacatctattgtttggattcctgttttagggtgtaagtccctcaagcccggggatttttttctccattttgttcactcttatatccgctagaacctacaataaggtctgacatattgtagatacttactaaatatttgttgaatgaattattaagatgagtttttatgaaagacattactgggcctgaagatactaacgttttaaaggctcttgatatctatgtgaaggtgttccactctactgtataagattgttgattactgctcatacacccatgacagtgctggccattgccattcttttaaaatttttaccgatctgttaggggcaaaatggtaccttactgttttaatacgtgtttcttttattataatgagattgaatacttttttatatttcttgattaattttgtttcctttctataaacatctatttatgatctttgtacatgttccattaagaacttacatttttttaaatttgtatgggcaatgtatgtttagttgacccattagacctctttctgtcaaatgtagggaaaatattctcccacttacattttaaatgtttacatttaaaagtttacattttaaattgacttttatgcatagtaatcttaattttatgtaattatatttatcttttcatttgtaatttcttctgatgaattcgtgtttaagaatttcttcctcattcaaaattggataagtgcttaaatgaattttgttttagtttttattgcttatgtttaatccctctggaatttattttgctgtgtagtgtgaggtaattttctaaattgttttccctgccaattgtttcatagcaccaaacactgaataattcattcattcccactgttctgtaatatatacaaattgtaatatataatagattctgtttggaatttatctattcttcatttcttttagtctgtctcttcctgtcctagttacaaagtttaaatattattgtagctttaaaataatttttattacctcagctcttctacttactagctgtgtagtctctctaagcctaaatttatctgtatagaatgggtagcagtaacatttattttatgctcttaattttgtgaaggggatctttctaccattatttctgctaattgattatgcagaaaattagtatttatgattttaacttctatttttttcactttgctgaaatttattattataaatgtatagtttacaagttattttcttgttttttttccctttttttattttggaaatttaagggaaactcagagaatctttcaaaacaatgaacaagtaaccacatatatactactcagagtgaacaactgttagcattttgtcgttttggcttttgatatgttttaataaaataaatgaaacattatatataaactttaactttctttgtgtctagcccccgtttcattcctttccacatccctccaaacgtgacactcagggccactcacatttgctgaattttctattcagttgcttcttcttactgattcataagacttatttatatattctggatactaattatttgtgatatatatagcatatatctgcttctataatgttacttcgctttctattttgtttatggggtcctttatcattacagaagttttacattttcatatcaggtttatcaatcttttcctccatgaattgtgctttttgtatcatgctttaagagatattcctgatgctatgatcataaaaaatgttctccaaaattttgctgaagagttcaagaaattttctttacacttagttctttaatccatctggattttattcttgtatgtgatgtaaaatattaagcagttttttttccatgtaaaatactatttgttttaaatatcatttatacacaactagtttagaccgcaaactccaccacattgcctaatttttatatgtgtttgagtctatttctaggctctctattgtgtttcattaatctatttgtctacacttgtgttgttttacctacaaatgctttataacgaatttgatatttgtaaagtcaagttactgttcactgccttcatccacactcacaccacttttcttgttttttctggattatcttatttttggtcctttcctcacttaccttaattttaaaacgaaattatcaaattacaagaaaataatgtttgtttttcttgaaattatattgaatctgtagaatgatttgaagaagaattgacatccttttgacagagatttcctattcatgaatatgttatatcttggcatttattcaggactttttgcaacctttgatgaaggttggtaaatttattgataatactcttacatattagatttagtcccaggcaactttattttttagtcagatttattaatgtataattagcataaaataaaacttaccctttgtaagtgtacagtttaagttctgacacatgtatatgattgtgtaaccactaccaccggtgccaccacaataaggatagagaaaatttcccttactataacaggttcttttgggcccctttgcagccagttcttttcttctacctacaattccaggaaaccatctatctgttttctttttcttttcttttttttttttttattatactataagtctgaggtacatgtgcagaacgtgcagttttgttacatagatatacatgtgccatggtggtttgctgcacccatcaacctgtcacatacattaggtatttctcctagtgctatccctcccctagcctcccaccccctgacgggccccagtgtgtgatgttcccctccctgtgtccatgtgttctcattgttcagctcccactaatgagtgagaacatgcagtgtttggttttctgttcttgtgttagtttgctgagaatgatggtttccagcttcatccatgttcctgcaaaggacatgaactcatccttttttatggctgcatagtattctgtggtgaatatatgccacactttctttatccagtctatcactgacggacatttgggttggttccaagtctttgtgaacagtgccacaataaacatagatgtacacgtgtctttatagtagcatgatttaaaatcctttggatatatacccagtaatgggatcgctgggtcaaatggtatttctagttcgagatcattgaggaattgccacactgtcttccacaatggttgaagtaatttacactcccaccaacagtgtaaagcgttcctatttctccacatcctctctagcatctgttgtttcttgactttttaatgattgccattctaactggtgtgagatggtatctcattgtggttttgatttgcatttctctaatgagcagtgatgatgagctttctttcatatgtttgttggctgcataaatgtgttcttttgagaagtgcctgttcatatcctttgcccactttttgatggggttgtttttttcttgtagatttgtttaagttctttgtagattctggatattagccctttgtcagttggatagattgcaaaaattttctcccattctgtaggttgcctgttcactctgatgatagtctcttttgctgtgcagaagctctttagtttaattagatcccctttgtcaattttggcttttgttgccattgcttttggtgttttagacatgaagtctttgcccatgcctatgttctgaatggtattgcctaggttttcttctaggaattttatggttttaggtcttaggtttactgtcctcaaagtgttgtttcttttatgctatcacatcaatggaaacatttggtatgtagtcttttgtgtctggcttcttctaattagcacttacttttaggattcatccatgtttttgcatattttcattattgtttattctttattattgctgagtaatttattcattcaacagtttagggacatttgtttttttcccactatttagccatgtcgcaatgctgttataaatgttcttgtacaggtttttgcttcacatatatttttatttatgctaggtaaatacctagaaggggactcctggggttatatgcaaagtaaatgtctaactttataagaaattgtcaagctattctccaaagtggctatataattttgcattcccaccggcagtgtgtaagagtctcagctgctcattatccccaccaccacttggtattttcatctttaaaaaactagaccaggcacggtggctcatgcctgtaatcccagtgctttggaggccgtggcaggtgaatcacttgaggtcaggagttcgagaccagcctggccaacatggtgaaaccccgtctctactaaaaatacaaaaattagcctggtgtggtggcaggcgtctgtaatctcagctactcgggagactgaggcaggagaatcaaatcacttgaaactgggaggtggagtttgcagtgagctgagattgtgccgctgcactccagcctgggtgacagagtgagacttcatctcaaaaaataataataataataataataaactttattttagaacagtttcggatttacaaaaaaattcaacggagttaccccatcccccaccccagtttcccttattattaacgtctttaatgtggtgcatttgttacaactgataaactgatattgatatattattattaactcacgtctatagcttgcatttgtgcacactctttgtgttctacagttctatgaattttgacaatgtataacatatatccaccattattgtataatatagaatagtttctctgccctaaaaaatctcctgttatatacctgttcatccctccctccagcctgaacctctagcaaccactgatcttttcactctctttaatgttttgccttttccaaaatgtcatatagttgaaattttacagtatgtagcttttaaggctggcttctttcacttgacaatatgtatttaagatttttccatgtattatcatggcttgataactcatttctttttattgctgaataatattcaattgtgtggatagacacataggctgtaccacagtttgtttatccattcacctactgaaggacatcttggttacttccaagttttggcaattatgaataaagctgctataagtgtttgtaagcaggtttttgtgtggatataagttttcaactcatttgggtaaataccgaggagtgcaattgctggatcatatggtaaaactatgtttagctttgtaagaaactgcctgactgtcttccaaagtggctatatcattttgcactgccatcagcaataaatgagcattcctgttgctccacatgtttactagcatttggtgttgtctacattttggattttggacattctaataggtgtgtagtgatacttcattgttgctgtagtcttcaattccctagcgacatacgagttgagcatctttttgcatgcttatttgcaatcttatctgttttgctgagctgtctcttcagttcttttgctcatttttaacggggctgttttcttattgttcagtgtaagagtcctttatatattttcaatataagttctgtactagatatatgttttgcaaatattttctcctagtctatggcatgtattttcatactcttaacagtgcgtttcacagagcaaagatcttaaattttaatgaaggtcaatttatcagtttttactttcatggatcattctttcttttcccctattttgtcttctaggacttttttggttttgtattttactggctatgacccatgttgagctaatttttgttaagaatgtaaggtctttgtcaagattcatcttttttctgcaagtggatgaccagttattccagcaccatttgttgaaaagactatcatttatcccttatattatctttgcttctttgtcaaggatcagttgactatattcatgtgggtctatctatttctggggtctctattctgttccactgacgtattcatctattcttttaccagcactacactgccttgtttcctgtcaggtagtgtcagtcctctaactttattcctattctttagtattgtgtttactattctgggtcttttgtcttcctatataaacttcagcatctgtttattgatatctagaaaataaattgttgggattttggttgggactgcattgaatgtatatatcagttgagaagaactgaccttaccaataatgaatcttcctatccaacaatactgagtcttcctattcatgaccatggaatatttctccatgtatttagatcttctttgatttctcttatcagagttttatagtctccttaaagatatcatatacatattttgttagatttatacctaagcatttcagattttggtggtaacataaatagtgcattttacatttcaaattccagttgttcattgctagtatataggaatgctattgacttttgaagattagtcttgtatcctgccttgtcagtctttcccgtgagtgcgtagtggtagctcattgtggtttaatttgcattttcctatgactaatgatactgaacattttctcatgtgcttattagccatctgtgtatctcatttggagaaatgtccattcaaatcgtttgcccattttaaaattgggatatttgtgttcttattattgggtcattctataatacaatatataatattaaatataatacaaattctttagaagatatgtgttttggaaatattttctgcccttctgtggcttgtcttttcattttcttaatgggttttctattatgacttgtaccttttgcattctaagaagtctttgcattaattaagttcaaaataattctctcttgttttgttctagagttttgtagtttctgttctttgatttatgtctttggtgcatgtttagatgacttttgcctttggagcaaggtaatgttccaggcatatacaatatatttttccttatgtatgtccagtttttccagccccatttgttgacaagagtatgttttgcccattgaattaccttggcacccttgtccaaaatcaactgactgtgtatggatggatctacttctggactctattctgtttatttgatctgtttgtgtaaccttgaaactaacatgctgcatcaattattataattcagtggttcccaactggggcaatattccccccagggacatttggcaatgtctggagacatttttggttaccacaaatggagggacatgctcctggcatattgtgggtagaggccaggcagctacccaaacaataaagtattgctctgccccaaaatgttaatattgttgaggttgagaaactgcaatagcattttcgtaaatcttgaagtaaagcattgtggatcctttaactttgttcttcatttaaaaattatttttgaaaaacaattaaaaactgtctttggctatcctaggtcctttgtatttccagataaattgatcagccagcttttccctttctcctccaaaaatgctactgaaagatttattgggattgagttaaatctttaggtcaatttgggaagaaatgacatcttaactaccttgagtctcctgatacattaagatggtataacgttttattgtttatttcttctttaaattatcttaacaatgttttgtatatttcagtgtatagatcttgcatatattttgtgaaatttatcttaagtaatacatgctttttgatgctattataaatggtaatttataaattttaacttctgatatttattattagtgcatagcaatacaattaatttttgtctattgatattgtatcttatgaacttataaaacttaattactagttctagtagttgttttgtttgtttttagattcttggtattttctgtattttattattattcctttactttaagttctggggcacatgtgcagaatgtgcaggtttgttacataggtatacatgtgccatgaagtttgctgcatccatcaacctgtcatctgcattaggtatttctcctaatgctatccctcccctagccccccaccccctgacaggccccagtgtgtgatgttcccctccctatgtccatgtgttctcattgttcaactcccccttatgagtgagaacatgtgatgtttggttttctgttcttgtgttagtttgctgagaatgatggtttccagcttcatccatgtccctgcaaaggacatgaactcaccctttgttatggccgcatagtattccctggtgtatatgtgccacattttcttcatccagtctatcactgctgggcatttgggttggtaccaagtctttgctattgtgaacagtgccgcaataaacaaacgtgtgcatgcacctttatagtagagtgatttataatcctttgggtatatactcagtaatgggattgctgggtcaaatggtatttctagttctagatccttgaggaattgccactctgtcttccacagtggctgaactaatttctacacagatgagtatgctgtctggtagtaaacacagttttaattcctattttccaaatcatatctttttttcttgctgtatttatattattttattttatttttactgtattttaactggataggacctctagtagaatgttgaatggaagtgtacagcagatctccttgccttgatcttcattttattgcaggaaatattcagtctttcgccattaactgtggtgccatctttggatttttatcacataccatttataagtttgagggagttcccttctatccatagtttggtgagggatttttatcatgaatgtatgctgatgatcttgaattttttaaaatgctttttatgtatctattgaaatgatctttctaagtctattgctatggtgaattacagtgattgacttttaagtgttgaaccattctaccatttcccatagaaccattctatttggtcatgatgtattattcttgttatatatatctcggcttatttttatttacagttttttttgtgtctgcattcattagatatattggtctttaattttcttttcttataatgcatttatttggttttggaaaagagtcactctagtctcataaaatgaggtgggaagtgttttttccgtcttttgtgaaacagcttgtgtagaattagtattctttcttccttaagtacttggtgtattagtcagagggggagtttattaagtattaacttccatgattacaaggtcccacaataggctgtctgcaagcttgaggaacaaggagagtcagtccgagtctcaaaactgaagaacttggagtcctatgtttgagggcaggaagcatccagcatgggagaaagatgtaggctgcgaggctaggctagtctcgcttcttaatgtttttctgcctgctttacattcgttggcagctgattagattgtgcccactagattaaaggtgggtctgacttccccagcccgctgactcaaatgttaatctcctttggcaacaccctcacagatacacccaggatcaatactttgcatccttcaatacaatcaagttgacactcagtattgaccatcacacttggtgtaattcaccagttgagccaaggtttttaactgtgaatttatacatttaatatatttaatagataaaaagctatagattatctatttcttctcaagtgagagctgatattatgtcttgcaaatattctgcctgtttcatctacattattaaattcatttccataaatttgttatattttcttattatccttttaatttttgtaagatctgtagtgacccacttgtcttcatttctaataaatgttaatttttgttttctttttttttctcattatctgtgtaaaagtttactacttttattgatcttttcaaagaaccagctcttagtttcattgatttttttttttttttttggtcttccttcattctatttcattgaattctgctcttatttttattatttccttccttttgtttgctttgagtttaatttgctcttcattttcatgtgtcttaaagtggaattttaaaccattgagtttttcttatctaatataagatttaatgctgtaactacccctatctgcactttttaagctacattacatagtttttgataatcatatttttgttttgtggctgttttttctattatattttctaattgatatctgtaagttggtcttgcatctagtattcttgaaaattcttattcattcttataatttgttgattcttttgaatttttttcatttctcctacaaatgaaaacgattttgccctccttttaagatccttatgttaaggtattatttcttttcttgttattttggctaagatacacaataaaacattggttactgataggcatggggcagtctttgtcttgtttctgacttgagtgagattgtttctaatgtgtctccattgtgtatggtatttcctctaggttttttggtagatattattcatcaaataaaataagtttcattgtatttctaatttgctaagatttctaccatgaatgagaggaaaatttcattgcatgatttttttcttcatctgttgagatgctcctatacttcttttttttataatatgttaatctattttaaaaaattactagtggtaattcaactccttttctctccttcatcttttttggaactgtgaattgcactgataggttattcaatattaagctctcctttcatttcagagaaaaatctgcttgattacagatcatatgtggctagatttatttgttttccctttaaaaaactgtatctaggttcttaggttgatattaccaatactgttcaattttgataagaatattgcattaagctaaaaggtagtttttatagctttcatctttttccagtttctggaactgtttgcagaagataagaattaattattttttattagtttaataaaactgattttagatcctggtgtgatcccattctttttttattgtatgcagagtgttaggagggagatttgatgtttagcctcctggttcaatttctgttctaatccatttagttttgttttttgtttgctatttgctatttgttttcctagggaattgtcaatttcttcagtttttgaacgtaatggctaaagttgttcataatattcttttatgattttgaacaagttttgttttttgttgaaagcatatgatttttttttaaagtttgctttttgttaaaagtatatgaggtcttaatttaaaatcaaatatttctccaagatttgttaaaaacaacagcagatccctgcccagcttcctagaagcaaccgtgttccaccatttcagattattcttttggtatttataccgtatttctaaataacatgcatatactgatccatcttaatttaaaatgtttatgcaaatttattaatttcctactctggaagataagtgttcagattctttgaaatctgccctacttgtacaacatatataagtttcttctcccatccccatactcttttaatttcagtataacttcgatttaattttttgtttatgttattatgaccatatcagtgccacttacagctgagccagataacatgttgtattagtttaccattgctgctgtaacaaattaccacaaacttagtgactgaaaacaacacagttttagtttttaaatagttttgcaggttttccagggctaaaatcaagacattggcagggctgtgttcctttttggaagctctgaggagaacttgttttcttgacttttccggcttctagagacttcctgcattcctttgctcctggtcccttcccccatcttcaaagtcagcaatgaccaggcaagtcgttttcacatcgtatcactctgacactgacttttctgcctcccacttctgactcttctccctcccacttccacttttaaggacccttgtgattacattgtgtttactcagataatccaaataatctattataaggttaactaattagcatccttcattccatctgctatttaatcactttttgtccagtagcataacatgcttacaggttctggggattaggacattcacatctttggaaggccattattctgcctaccatatataagagcattacttttcattttctgtgcaaagtttagttttcactggaataattgtctttttaaaatgtgcttatcatttatgtactacttatcactacttcaagctcaaactctcttccagtgttgacatgttttctcagtaaatgcagacataaaagatattttattagttttatcttcttattgaaattgtttctttactcttttcccctattaaaatttggactggcttctctctctgctttgttcatagatatcatcctggaatctccatcactatccttagatttccttcctgtttctcttgagttgaaaacattgctccactaccttctagcttccagagtatctgctaggaaatctgaaattattcttgaacatctgtgctcaatttcgtctttctttctcttgaaacatgtaggatattcttttcatctgttgtgttctaacactgttgtaggttcttgtggatctattttcatccattgtgctgatattcagttgactttcaaaaaaagcctatgggatttttttttgaattatttcattgctattctttctttccctctcatttactcattctcacactagctcgttgtccctatctgtatctctttccctttccctcctactattttaatattggccctactaggctgattttattattttcttacattttctattgtccatctcattgtctaaatgctgtatattttggaagatatcttcaactttatctccccacacttctatagagttttgcatttcccgtattatgattttacactgtaatgatttaaaaatatatatcctttgaatttcctttttttatggcaacttgtccttttttcatagatgcaatactgtgatcagtccctagttcagaaccactttttatgttgtcagtttggggcttttattccttgaagatatcaaaggtcaagtttttgaggcagtgcttggcgtgatgcaagtcttagttgcataactatctctactgcctacctgggcaacaccccagttgccagtctcagcttcctgggctggtcatagcatttttagagttattctgcctaggagttccctgcctcatcgtctggtttcctgcagtgatctagctttgctaccctaccatatattcaatattattggtttatgttaccccacagtacttgaacttctggctgcctcttcctgtttcccagtgggtaagtggttttattctctccaaccccatccccagcctattgctgagttcatttttctgtttcagctgcatggacatattttattttttctttaacagttgtggttgtgtttttattttttaatgtatgttttatgatttagttgtcatcactatattctatgtttgaagctgagagagggggatttttttcctgtgtgaactcaaattactagcttgacatgataatccttcaggatttttagatggataataaattctccttcaaataatggctactcaacatttgggaacttagttatgaagaattctctatgattagttttctatacttaatctgtaatcatagattgcaacattcacatatctgagtatcagtctatgttgtgaagcaacagagatatggatccactcaggttaggttaagcagacaggtgtttttgactctgggatcaggaacattggacttgcctaaacctagggcccccattggtatcaaaggaagttttgtaggtcaggtgagtggcaatggttacctcaggaggagagtcttattgtgacagacaggaagaagagaagacaggagtgtgaagaagttgtggttgccagattgatgtttgaactttaaatggaaataggaaaattagatgacaaaacaactatttttaggttgaagacaatgtttctgattgtttcaggaggggtgaatggagccaatggaggttttgccatggtttgaggtcatctctaaggtgggaaggcgtgatttggctagatcttaaaggaccttgtaggtcaaattcaggagtttagtctttccctcaagagcagtagggagcctttgaatagttttaagcaagggagtaaagcaatctgattcgcatttttatggccccctctggttgctgtgtgaagaataggttaatgctgcagaagggcggctgaagtgaatgtgaggccagtaatgctgctttggctaaaatggtaatctggagaaagagagggagggagggagggagagagagaccatgggtttgagaggtatattggaggtagattaatagaagtagtggaaggaatatttagcaaacactaggaagtctggctgaacttgtacttttccctgcatttccttctttaaatttatttcctaccagttttcctgacctgtctcactcacctatggggactcagatatcgttcttacctctcttttaattcaattctttcatatttaatctccaatcttctgctttattccagtgacacaagggcttggctgtgttcttgtgctgggatcccataatcagtcactccattttctttctttgctttccacattggtgacccattaagtgcattcttcattttcagtggtctattgtttttcttcaatttctggcttgctttcaatccatctttctcagttttcagctgggactaacttgagaaaaaacctctcttgctcttgagtagtgggtgtatgcttgccaaatgtttgcaaaaaaagtatctcattgtacaagtggcattccagctgcattaacacccaagcagaaataagtaaatactcaattttagaactcactgtcatctttacttgtggagtgattgcctcctgctttctgagtgcctgtttaggaatctataaatgacacagtttccacaagcatttggggatcctgggcagtatctatgctacaacaatgctcctggttatatgctcagtgggggctggaggctgaaattggtatatattaatgcaaccttcctctgtttttgtgtctagtctgcagattctccacttttagataaaggcaggttgcctgaactatgcacattgcacattcctgtttatagctcctgtaccctggggacaaactacaaatctgcagttactctttagcgtacagcttcatctgtctgactgcagccccagggactactattgagagtagctctttggatgagaggagggacgccaccgcatagcagccagggctctgaatcactgtctgcagggtgcatgttttggaatctgggtgctgagttagaagggactatgagtcagtgcactgttaggacggggccagttgtatattgggccagcagcctgcggagattatacaaatgagacagggtgtctctccttccttggtgatttacttcttaaattattgtatctaattggtaggtctgtgaatctctaagtggcgtcattgctttgccaagtacattgcaggggcaagtacaagaatacttttagctattacctgtattctcataaaaagatgtttagggtaatataagcaatatatatggatgggtgacagctctccagatgttttggtgtgctgaagcgccagccaggatttggctgtagatgttgtggccagagctgacaaattcagtgtttgcttattagatctcttgtgttattgatctctgcagaactcagataaattcaaattccacttcatgaacctcttccttgggcattcgttgttttcttggtgagaaacagaaagttttagctttcattttagcatctatttattgagtatatgaaatatatcagctgactgtgctagaagttaaggatataatggtgactcagatagacctggcccctgcttttttggagttcgcaatctaaaagggaaggcatactttgaaaaagtaattttccggtgagccgaatgctgtggaaaagtagcagaaagtgttataaagaaattaaaaagcagacctaggttagtggggaacatgacaggtaaattttctttaatgaagtaatgttcaagcttagaatgtaaagatctatagctgtttgccatttcagtagtgatagggagagagatgggtaagaatattccagggagagggaaaaggttgcatgaaggccctgataatggcaaaattcatgctgcattctaggaagtaagagaaggtcagtatggctggagtgtacagaatgagatgtgaaaatagagatacagagtacaatgcagtgtttgggccttattccaaggtcatagaggagtcattaaaggactttaaacagggaatgacatagtcagatttgcaggtttcaaagctgattctggcagcaggcaatggatttattgtcaaagaagtcaaaagtagctatagagggagaattaggtgtgagagataataatgatgacttcatctatggtggtgccaaaggagatggagaacagtaatgaggaggcagcataacatacctgccgtattgggttattgtgagggttaaataacttaataaatataaagtgcttagaacagtgcctaacacagatcatgtttcaacaattttaagaagcccagtctcttcccatattttaatatttcccaaataagtatgactcttagctatcaatgacatatcattgtttatttggcagcacatttaatgtgctagtggcataaaaaatattgttgtatctgaaaatttgtggcaacttagatgaaatatgatagttaagtgttagagatatatttgctcttatcatttttctattattattattctgccaaaatctagtgggagataaactcagacacatagaaacaactaatgctaaaccacttcgaataaggaatgcaacgaagaaagtacggagaaaggaagtgacagagaaagtacagcggaggtatacctacctgtttggagaaactgattttcatcaagggaattcttagaagtgagatagaatctcaccatgcccaccacagggttggatctagagtagaattgagtatgaagtgttgactgttagagacttgcaactaactcttgcaagttaatcaattcacctgtacttgtgaatacatagcaaactaagcagtatgattgtaagagtgcttcttatgaagactggatatctcttaatccagaaagaagattaaccctatctatcacttgtgcagcttcctttacatactaaacatgattctagtttgttttacaagaatataatcctacccacccagtgaggtaggtgatggtatccactattcgcatatgaggaagtccaaggtcatatgcagttattctgatctgggatttgaacttggtttctgtgtgactcaaaagtgtttcctttactcttagctgtgtcttaaaatgccagattctgagttaagggagagaatctgacctttcttggatggcattaaataatactagctcctcatttccacaattatagtttagtaggggaagacagacattataattttaattacataaataaataattgggaattataagaagtcataggaagaaaacacacaaagttctgtgttcgtggaaagcaaaggagatgggatttctaaaaagatactatttaacctggacctacaggatgaaaaggagcctgccatgcaaattgagatgaggaagagttttctgggcctacacatgggctctgagataagaagaaacatattttattcaagaagtacatcagggaaaggggacagagtaggaatagataagcagataaggacagctctcctccaggtgcgagagtacaagcagaaaccaggacagaagttgaaagtcaccactttagccaactgatcaaacatcacatcacaacataaaaaacaatcatgtgtctcctgatgtgatgcactaagggcacaatattacttagatagtgttctttccccgaacccataaccctagtttaatcatgagaaaacgtcaggcaaactcagattgagggacattctgatcttttctctttaaaaatttcattttcatgaaagacaaagaaaaattggggaaatgttccagactaaaggagactaaagagatatgataaccaaaggtgtgatcctacattggatcacacatttacctagacgggtaaaaatcactatagagagcgttattgggacaattgttgaaacgtacatatggattctagattagatgacagtgttgtatcaatgataagtttattgattttggtaattgtatataagtgggttatatacaagtgtgatattgttctttagaaaaatacaagccaggcatggtggcttacacctgtaatcccagcactttggcaggctgaggtaggtaattgcttgagtccaggagtttgataccaacctaggcaacgtaacaagattctgtctctacaaaaaaaaaaaccttagctgagcatgatggagcatattgtagcctcagctactcaggaggcagaggtgggagagttgcttgagcctgggcctgggaggtcaaggctgcaatgagccatgattgtgccacttcattccagcccgggtggcagaatgacaccctgtaaaaaaaaaaaaaaaaaaaaaaaaagaaaagaaaaagaaaatatacaatgaagtatttgcaagtatacagatacaatgtgacaaatgttaagaaattgtgcatatggacaaagagtatgttctatttctggaattcgtttggaagtttgaaattattgccaaacaaaaagtaaaaacaaagaaaacatttaaataaaaccactgtgggcacaccaaaagcatattatagtagtgaagatgaatgataaaaacagcttataccagggtagctggcgatggtgatggcagctactttggggtggggtaggggaaaattggcctgacatcatttagatgtacaatgttaagttttgcctatgctaataattttcattatttttaagattactcttgaagccattgaagcatttcaagtggtgggggagctgctgacaaatcaggttatgaaatgctaaacttggctactgtgtaggatggattagaaggagacaacagtagattccagaaaaccagttagcacagtgtcatatacaaagtagatgcttagttattgtgtgattgaggctttagcagtggccaagagtgagtttgtaatggcttgaactagtgttgtggtgaacaatgtgaagagaaataaatgtttttgagggggtgttagggggtaaaattgataaaaagttagacgaaatagacatgggggctgttggaaagggagatgtgaaagatgacttgtcggtttctgattctgcagttgggtagatgatggtactgttcactgagatagggaatgatggaagattatttgattttgggagaatgctgggatctagagaaaattaattcaatcacacagttcaaaaataaaatgaaaaataaagatacacaatacaaaaattgttcttattacaatccctatgaatcatgttcttttcccacaaccctaaaatagctaactttcaaattaatatattagttatcttcccacagttttaaaatattgttttagtgtgtatttttatgattgctattgaggttgaatatatttttacatttgttatccatttgtaatatccaaatgtaatattacatttgttatccatttgtatattccatttgtaatccaattgtaataccaatatccttggtaattatttgtccacatcctttcttcaattttgtattttctttgatgttttaattactgattcatattagctcctcatatatcaggaatgttgatattttcttctaaaccctagtctgttgcttagctcaaacattattgatttttttgttacagagaagtgtaaaattaaagtgtacagaaatatcttcatctttcccaagttcataaaaatatgctcctaaatattttaatatattcagtatttgttgttcacatttagtagcattttattccattgtgcataaaagcctaactttattttctaaaaggatacatttgtccagtgcaacttattgaatacttcataatttcctcattggtcataaattgttctttcatcctacactaaattcctgtatacatatgaatctattcctggaacccttgatttaatttcacttattctttttctatttttacctcagtaccaaactttaaatttgtcaggtttgttaaaataactaattcatgcgcaagggtcataattaagtacaaagatgtctacagtgaaaagtaaatctctttaccatttgtgcccaagtgtcaacaagttcccctgtgaggaggcaacacctatcaccagtgttttggtgcatacacatcatgacacacaaatattctagtactacaatgcttcatttctttagttttatagtatttgttgttcattattagatgaaatatcttctcatagcatttttcaaaatataattacaagcattttcttataaaccttaagcttgacaagtttttaatttattttaattgacaaatgaaaaatgtacatatttatggcatacaacatgatgttttgaaatatgtatacattgtggaatgtctaaatagacatatttattaacatatgtattaccattacctcacatccttttggtgagattgcttgaaatctactcttctagcgagtttcaaatatacaatagattgtcatggactattgtcaccatgttgtataatagatctcttaagttcattcctaccgttgaactgaaatgttgtatcctttgagcaacatttcctcaatctttaagaatattgtgttgggaattttattagaagtacattacattatagaaaatcttgaaaccactagtatctataaaatatttcgctctctccagtcagaaacgtgctatatttccatttactcgggtcttcttttcaatagatgttttgtttaaagaaaactttctaaattgaagtatagcatatatggaaaaaatgcaaaatcctaattgtacagcgcaatgaatttttgttaaatgtaaccactatcagggtcagaaaataaaaaaaaaattaacacaccagaaccatctctttatgtctttcttggccattgtccatactccccccacaaagataactaataccctgatttcttatagtagtttcacttgtttttaaactttatataagtcgaataatattctttatactccagtatgtactttcttgtgtatggcttgttttattcaacatgattttgagattcatccacgttgttgcaaaagctatagttcattaatttttagtgctatgtagtagtctcttctataaatataccacaattatatatccctcctactgttgatggacatttaagttttatctcgtttgatactattataagtaatgttgcaataaaacatttgtatacatttcttttgctgaacacatgtccacattttgttgtctgtataactaagatgagaattttggggtcatagggtatgcatattttcaacttattagatactgccaagaagtttccaaagtttttgttcagatttacacatccactggcagtgtatgaaagatcttatggctctccatcctgcccaccaattactactgttatacatttaaattttagatattataatatgcttgttttggtatcttatcatagtaatttagatttacatttccctgatgacttttgagattgatcataatttcatatgctatttgccatttggatgttcttaaacattttttgaaaagtttattcaaataatttgttcattagtctattcaattgtcaccatttgctttttactgatttataattctttatattctgaatactagtcctctgtcaaatatatgtattgcatgttatcttttcccaccccatggggcttgccttttcactcttatttgtattgtcttttgatgaacagatattcttaattttaatttagtctagttgatcagacttttactttatggttaatactttttagttccatttaagaaatacttgcctacctcagtatcatgaagatattatcctatgttatcctctagaagctttattgttttacattatacaaacacacacgtatatatttaaggatatatatacagtaagtcttcacttaatggcatcagtaggttcttggaaactatgactttcatggaaacagcatactatataacaaaaccaattttaccataagctaattgatataaacgagtaaatttctatggcttacagtatgttgtttccttgaaaattgcagtttccaagaacctactgacaacattaaggtgaggacttactgtacctatataacgaaaggtatatattaattgtatatataggtgccttgtgtgtgtgtgtgtgtgtgtgtgtgtgtgtgtgtataatgtgtaaatatcagtgtgttagtccattctcactctgctatgaagaaatacccaagactgggtaatttataaaggaaagaggtttaattgactcacagttccgcattgctggggaggcctcaggaaacttacaatcatggtggaaggtaaaggagaagcaggcacctttttcacagggcgacaggatccactatctccacctggtcccgaccttgacacgtgagaattatggggattataattgaggtgagatttgtttggggacacagagccaaaccatatcaatcaatataattaatttatttgtatgatgtgtggtagtattcaagagttattcatttctatgtggatatccaaaagttaaccaattaattaatctggtagtataatccctcttttgtccttttcgttctaaattttagaatcggattgccaattcccagacagtaaaggacctcttggaatttgttttgcaattgcacaaaatctatggtcaattttgggataattattatttttacaaattgtagtgttctaatttgggaacatgatatatctgtccatttattatgtttttattttttagtgttatttgatgctattttaaatgtatctttgtaaaaaaaatcactttctaaatttttttgtggtatttaaaatataatcaattttagaatattgatcttgtgctcagagttactgatgaatccatttattaatgctactaatttatctgtagtttcattaatttttcaaataatttaattttcatttcttgattttaagtttttacaaatttcatatttttcctgccttattgtattgcctaagacctctagtacaatgctgaacgtaagcagagatcataggcatcttctatttcattcctgaccttgggggaaatttctcattatttcaccattaagtatgattttcactatagagtttttaaaataccctttatcagattaagaagtttccatttttagtttgcaaagactttttaaaaaatcattaatgggtattgaattttatcagattttttttctacatctattgagttgatcatatatttttctcctttattctgttaatatgatgaactgcattgactgattttcaagtgttaaaccagccttttattctttatataaatcctactcttcgtgttattttgcaacacaggatgggaactatgtgtatgcatgtgtgtgtatatgtgtgagttttaaaatttttgcacccacatttataagtgagattggccgtcagttttcttttttctgtcaagtttgtgtgaggttttgggattaaggttatgttagcttgaaaaatgaattgggatgaaaaactatttttttttctttacattctggaagatattatgtaagactgatgctatttattctttaaatgttgagaggaattcactggtaatgccatctgggactcaagttttctttgggggaaagtctttagtgatagattcaatttctttaagagttataggagtattgggatgtttttattaccttcttttgtcagttttaagttatgttttcaaagaaatacgtttttctaaattttcatgttttttggcataaagtccattttaaaaatatgatacctcttttctctttagtgtctattggatctgtaatgatgccctcctttccattcctaacagtagttgtttggttattttcattttttcatttgttattcatcaggcttgctggtggcttttaattttcttttttcttctttttttgtgtgttacatttattttttattttattttgtattatactttaagttttagggtacatgtgcacaacgtgcaggtttgttacatatgtgtacatgtgccatgttggtgtgcagaacccagtaactcgtcatttaacattaggtatatctccaaatgctatccctccccgcaccccccaccccacaacagaccccggtgtgtgatgttccccttcctgtgtccatgtgttctcattgttcaattcccacctatgagtgagagcatgcggtgtttggttttttgtccttgcggtagtttgctgagaatgatggtttccagcttcatccatgtgcctacagaggacatgagctcatccttttttatggctgcatagtattccatggtgtatatgtgccacattttcttaatccagtctatcattgatggacatttgggttggttctaagtctttgctattgtgaatagtgccgcaataaacatacgtgtgcatgcacctttatagcatcatgatttataatcctttgggtatatacccagtaatgggatggctgggtcaaatggtatttctagctctagatccctgaggaatcaaccaacttttgtatttgctgggcctctttattacagattttttatttcattgatttttgattttatatttgttattttgttctttctactttcttcggttttaacttgcttttattctactattttagatgtataattagatcacagatttatatacttccgtcttttcaaatacatgtatctaagcctataaatttctctctgataatggctctgttgtatcccagaaattttgatttgctatattttcattttcaggtagtacaagatgttttctggtttaatttggatttcttctttgcaccatggtttatttagaattaatttgcttaatttccaaattgagatgattttctatttgttattaattttttctaacttaattaaattgtggtcagagaatatattttgactccaatcatttgaaattggtgtggtctgcttcatggcccattcaacagtaaattttgtttaggttaaatatgtatttcaaaaaatgcaattcttgcacttttgggtgttatgttttaagtatgtcatttaggttaagtttgttaattattttgttgcaatcatatgtatctttactggtatctgatggccggtactattagttacagttattacatcctgaaatccagttatgacatatttaattctataatatctattttttcattttttttcttttttttcttcttttttttattatacattaagttttagggtacatgtgcacattgtgcaggttagttacatatgtatacatgtgccatgctggtgcactgcacccactaactcgtcatctagcattaggtatatctcccagtgctatccctcccccctccccccaccccacaacagtccctggagtgtgatattccccttcctgtgtccatgtgatctcattgttcaattcccacctatgagtgagaatatgcggtgtttggttttttgttcttgtgatagtttactgagaatgatgatttccaacttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacagtggttgaactaatttacagtcccaccaacagtgtaaaagtgttcctatttctccacatcctctccagcaccagttgtttcctgactttttaatgatcaccattctaactggtgtgaggtggtatctcattgtggttttgatttgcatttctctgatggccagtgatgttgagcattttttcatgtgttttttggctgcataaaatcttcttttgagaagtgtctgttcatgtccttcgcccactttttgatggagttgtttgttgttttcttgtaaatttgtttgagttcattgtagattctggacattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccatttcttgtttttctcaggtttgtcaaagatcagatagttgtagatatgtggtgttatttctgagggctctgttctgttccattgatctatatctctgttttggtaccagtaccatgctgttttggttactgtgtagccttgtagtatagtttgaagtcaggtagtgtgatgcctccagctttgttcttttggcttaggattgacttggcgatgcgggctcttttttggttccatatgaactttaaagtagttttttccaattatgtgaagaaaggcattggtagcttgatagggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaagtattgtatgaaaatttccattatgtctatttttttaaaaaatgaatcatcattatttaattggccatgcaattattacagtacatagattgcatctgagactttttctagtattttcttttcctttctgagtcttatcttattattggtaattgctgtttgaatgctgggcattttaagtgaaatagagaaagccctagttaatgttacctttaaaatgttttttattttgaaataataaactcatgggaagtcgcaaataataaactcatgggaagtacatagagacctataaactttttacttagagtcacccaatgggaattctgataatgacggtagtacaatgttaactatgccatagacttcattaatattattatattgcaacaataaaggaatggtttgatgtgtgctcttttttgtgtgtctctatgtctatagttctatgcaatataatcccatgtatagatttatgtaatccccatcacaatcaagataaagaactgttcaatcaccataaatataaaacccctcatgttactcctttatagtagtatccgtccctgtctctttccatgaaaccatgaatctgttctccatctctatggttgtgtcagtttgataatattacataattgtaattatatactgtgtaacttttttaaaattggcttttagaaaattaatagggtttatattttagagtagttttaggtttacagaaaaattgaggagaaagtacagagttcctatatattcttttcttcctctccctctgagtttcccctattattaacatcttgcatgatgtggtacagttgttactatgaatgagtgaatattagatacatttttattaactaaagtatatagtttgcattagagttcactctgtgttgcacagttctgtgggttttgacaaatgtataatgcattgtatccaccaatacagaatagtttcattgccctaacaatccccagtggcccacctacttaactctccctcttttcctccaagcccttggcaaccactaatctttttagtctttatgtagtattttccaaaatgtcataattagcactatacagtctgtagccttttctgattggcttctttcacttagcaatatacatttaaggttcctccatggttttttttttttttttggtggttcgatagctcattttttttagtggtgaataataatattgcattgtttgtatgtgtcacaggtcatcttggttgcttccaagttttggcaattatgagcaaagctgctataaacatttttgtgtaggcttttgcttgtaaataaactttcaaatcatttggataaataccaaggagtgttattgctggatcatatggtaaaagtatgtttagttttgtaaataactgccagactgtcttccaaactggttgtatcattttgcattaccagcagcaatgtacgagaattcctgttgttccacatcctcatcagcatttggtattgtcaatgttttggaatttagccactgtaatagatgaaagtggtatttcattgttgttttaatctgcgattccctaatgatatgtgatgccgagaatcttatcgtatgcttgtttatcatatgtatattttctttggtgaaagaatgacactttgactaagcatgatgatcttgagttccattcaggttacttcaatacatgcagcagtacttgataccagtaattggtaccttttcattactaagtagtattctgtagtatgaatgtactagaatctgtttatttacctgtaaaaatatttttgcgttgtgtccagcttgatcctattaaaaataaaggtggtgtgaacatccatgtacaggtttttgtatgtacataaaattccatttctttgggatgaatgtccaagaatgacattgatacgtcttatggtaggtgcatgtgtggtttttaagaatctgccaaacaattttccagagtgcttttaccatttaatatttaaatgagaatagctttttttattttgctttgtaagtctgttgctagtatatagaaataaatttttttttcgcatattgatcttgtgtcctgtgactttgacaaactcattattggtaggagattttttttttattcctcgggattttctacataatgaattgttatctgcaaacagagacagtttaaagtctttccttccattctgtaggctttttgtttccttttttttctttattgtattggttaggatttctaatattgtgttaaataaaagtggtaagaacggacaccttcgccttgattttaggaggaaacatttcaccatgaactatgatgcagctcaacgtttttttcaggcgttctttataaagttgagcaagttttcttccatgcctagtttgctgcaagttgtttttataaatcatgtataggtactggattttgtgaaatgatatttctgcattatatagttttgcctctttggcatgttgttatggtgggttaaattgattgtcaaatgttcaaccgaccttgcataactggaataaatcttacttaattaagatgtataattagttttatatttgatggactcaatttgctaatgttttcttgaggatttttgtgtttatattcatgaaggatatttgcctataatattcctttttttctgtactgcccttgtttggtttttggaaccaggacaatactggcctcataaaatccgtttattactgttctttcctattcaccttttgaaaagagattttgttgaattggagttattttttttttaatatatggtaaattctctagtgaagccatctggtctgggatttcattctttaaggtttttggtgagaattcagctgataatcttattgaggatcatttgcatgtgataagttgcttctctcatgctgctttcaaaattttttgtttttgtctttcaaaaatgtaatcataaagtgtcttggcctggatgtatttgaatttattaaacttgaagttcgttgcacttcttggtttcatagagtcgtgtctttcttaaaatttgggaaattttcagccattagttcttcaaatgttctttctgctcttttctctctcctcctcctctgaaacgcccattatgcaaatgttccacatgtctcttaggttttattattattcttttttaaaccattttaaagtgtacgtttcagtgacatttaatacattcacattgttgtgcaaccatcaccactatctgattccagaacactttgtcatcccaaaagtaaacctcatacctattaggcagttactccccattcccctctttctcaaacccctcatgaacgctaatcttcattttgtctctatggatttacctattctggatattttgtatatatggaatcatacaatatgtggtcttttatgtccattttctttcacttaacataatgtcttctaggttcatccatattatagaatgtattagtacttcatttctttttatggaaaaataatattccattttatagttgccacattatatagttgccacatactcacaatgtgtatgtcacatttgtttatccactcatccgttgacagatatttgtgtggtttccatcttttgtctattgtgaagtgtactgctatgacattcatgtacaatttttcatttgaacatgtgttttgaacttttttgggtatatacccaggagtggaattgctgagtcataagtgaattctgtgtttaacttactgaggactcaccaaactgtttttaaacagtagctgagccaatttgcattctcatcagcaatatataagggttctaatctttccatatctttatgaacacttgcttttatctttttttaatgtcaccatcttagtggatgtgaagtggtatgttacaatttttatttgcatttcatgttggctaaatgatgttgaacattttttcgtgtgcttgttggtcatttctgtatctttttttggagaaatgtttattcattccttagcccactgaaaaaaatttggtaagaagctggtaacctttatgtgattctttttttaaaaaacagctttatcgagatataatttacatactggaaattacttgtagcccatcttttaattaggtaattaactttttgttactgagttgtaagagttctttatatattgagggtactagacccactgcagatagatgatgaacaaatattttctctcacttgtggatgtcttttcactcccttgattgcatcatttgatgcatagaagtttttgtttttgatggaatccaatttatctatcttttattttgttccttgtgcttttggtgttgtatctaagaaatcatttcctaattcatgttcatgaagaccaacctctatttttcatctaataattttatagtgttagctcttagaggtagatgtttgaacgagtttgagttaaattttgcatatgataagtgaaacagatccagctccttttgcatatggatatccagttgccccaacatttttcttcattatttttttcttttttctctacagaaagtaatcccaattgattctttttttccgctgctcaaatatactgttgaatcttcatagtaaaattttcattccagttatactttttaacttcagaatttttatttggttctttttttattacttatttattttggttgttgttcatttttgagacagggtctcactctgtcacccaggcttgagttcagtggcacgatcatggctcactgcagcctccatctgctaggctcaagtgatcctcccacctcagcctcccaagtagctgggactacgggcacataccaccatgcccacctgatttcttattttttaattttgtagatacagtgtctcactatgttacccaggctggtcttgaactcctggttgcaagcgatcttcccaccttggcctccccaagtgctgggattacagacatgagtcaccacatgcatccttcgttcctttttataatttctatttcttattgataatttctgtttggtgagacatttttcgcctggtttcctctagtctttgctcatggttttctttagctctttgaacatttttaaaacagtttatttgaagtctcttcctagtgagtccaatgtcttaattttgtccagggacagtttctattaattttcttttttgttgtgaatgacacatattttcttgtatttttgtgtgatttgtatatcttctttggggaaatgtttttggaataatattcattttgaatattatactgtgttcactgtggagattaaattttcccacttccccaggattggttactattgcttttttgtgagtttgtttgtttaatgattttttataaacaatttatttaattttttaataattaaaatttttatttgaaataattatgggtacataatagttctatatgttgatagagtatatgtgatgtttttgttttttaaatataaaatttgttattaattattatggatacatgatagttatacatatttatggggtacatgtgatgtcttgatgcaggcatacaatgtctattgatcaaatggcataattggggtacccatcacctcaagcatttttcatttccttgtgttaggaacattccaatttcacttttttttatttaaaaatacacgataaattattgttaactatattcactctgttctactatcaaatactacctcttgttccttctaactgtatatttgtgctcaataaccattacctctttatccttccccccacaacccttccctgcgtctgataaccctcattctactctttatgttggtgagttgaattgttttaatttttagttctcacaaatgagtgagaacatgcaaagtttttcttttcatgcctggcttagttcacttaacataatgaataatgtcctgcagttccatccatgtttttgcaaatggcaggatttcattcttttttatgacaaataatatttcattgtatatatgtcccacatttcctttacccatttattcattgatggactttaggttgattctctattttgcctattgttaatacagctgcaataaacataacagtgcagatatctctttgttagattgatttcctttcttttgggtatataatgaacagtgggattgctaggtcatacgatagttctctttttatttttttgaggaatctttgtactgttctccatagtggctgtactaatttacctttccaccaacagtgtatgggggttgccttttctccacatctttgccagcattcattattgcctatcttttgttcatttataaatcagattttttttggtattgagttgtttgggctccttgtatattctggttattaatctcttttcacatgggtagtttgcagatattttcttctattctacaagtggcctctttgttgactgttttctttgctatgtagacttttggctttatgtgactccatttgtccatttttgctttgtttgcctgtgcttttgaggtcttagtcaataaatctttgcacagaccaatgtcctggagtgtttccctaatgttttctttcaatagttttatagtttcatatcttagatttaagtttttaacccattttgatttgattgattgatttctttctttagagacagggtatcactctgtcaccctggctggagtgcagtggtgcaatcatagctcactataacctcaaactcctagacaagagtgaacctcctgaatagcagaaactacaggcatgtaccaccatgcctggataattttttaaaaattattttttgtagagattgggtctcactatgttacccaggctggtctcaaactccaggcctcaagcgatcttcctgcctcagcttcccaaagcacttgaattacaggcatgagccaccatgcctggccaattttatttttatgtatggtgagaagcaggggttgaatttcattcttctgcatattggatatccagttttctcagcaacatatattgaaggggtgtccttgtcccagtgtatgttcttgtcatctttgtcaaaaatgaattggtcacaaatgcatggatttatatctgatttatctattctattccattggtctatatgtctgtttttatcccagggccatgctactttagttactatacctttgtagtataatttaaagtcaggtaatacgatttctccaggttttttttttttttttcctcaggatgactttgacttctcctggtccttggtggttgtggttccatatacatttaggactattttctctatttctgtgaagaatatctttggcattttgatagggactacattgaatctgtggattgctttgcatagaatggacattttaacagtattgattcttctaaaatccgtgaactatctttccattttcttgtctgacaatttcttacatcaacattttgcagttttcattgtagatatctttcattttttgtttatttctagatattttattttatttgtagctattgtaaatgggaatactttctttgtttctttttcagattgttcactgctgacatataaacatgctactaatttttgcatgatgatttagtatccggcaactttactgagtttttaaaaatcagttataatggttttttttggtagaatcttttggtttttaacaatataagattatatctgcaaaaaaggataatttgacttcttcttttccagtttgtatgccccttatttctttatcttgtctaattgctctggctaggacttccagtactatgttgaataaaagtggcaaaagtgagcattcttctttagttccagatgttagaggaaagactttccatttttccctgctcagtatgatactagtgtgggtttgtcatatatggcttttatcatgttgagatatgttctttctgtacccggattttgagagtttttgtcatgaagggatgttgaattttattggatgctcttttttttgacatcatttgaaatgatcatatggtttttgtccttcattctattgataataatgtatcacactgattggtttgcatatgttgaaacatccttttattcctgactcatctcttggtcatgatgagtgatctttttaatgtgttgtttaattcagcttactagtattttgttgaggattttagcgtctatgttcattagtgatgctggcctgcaatttgttgctgttgttgtgtcttcctctggttttggtattggtgtaatactggcctcatagaatgagtttggaagtattccctctgcattttttggggacagtttcagtagaattgatgttagttcttctttaaatgtttgatagaattcggcagtgaagccatcaggtcctgagcttttctttgatggaagacattttattacttcttctatctcattactttttattgatctcttcagcttttggatttcttcatggttcaatctttgtaggttgtatatgtctaggaatttatcaatttcttctaggttttccaatttattggcatatagttgcacataataatctctaataatccttttagtttctgtgatattatttgtaatgtctcctttttcatctctgattttattcatttgaaatttttcctttttttgtaagttagttgggctaaatatttgttgattttgtttatttttttaaaaacaagttttcattttggtgatcttttgtatttttttagtgtcaatatcatttatttctgctctgctctttattatttcctttcttctactaactttgagtttgttttgctcttccttttctagtttttaagatgaagccttaggttatttatttgtagcttttctaccttttcaatctaggtgtttatgctaaaaacttccttctttgtattgccccataggctttgatatgttgtgtgttcattttcatttgtttcaagaattttttaaaaatctttttacttgtttattggcccaatggtcattcaggaacatatttaattttcatgtgtttgtatacttccaaaattcctcttgttattaatttctagttatattccatgtgaatggaagaaaaagatagcttatgtaatttttttattttttgagacttgctttgtggcctaacatatggtctatccttgagaatgttccatgtgcttagtagaagaatgtgtattctccagctgttggataaaatattttgcaaatgtctattatgtccagttggtctattgtgctgattaccttggaggtttctttcttgattttctgtctggacgatctgttcattgctgaaagtgggaagtagttgtccccagctattattgtattagagtctatcttgctctttagctctaataacatttgccatataaaaatatatatatatatatatatatattccagtgttaggtgcatagatatttaaaattgtaatatcctcttgctgaactgacccctttattatcatataattaccttccgtttctcttcttatagttttttttttgtcttgaaatctattttatctgatataagatagctaatccttctgttttgggtttccatttgcatggaatatctttttccatcctttttttcttttcattctacgtgtgtctctacaggcgaagtgaatttcttacagacagcatagatttgggtcttgttttcttaaatccattcagccattccatatcttttattggaaaatttagtccatttacattaaaggttattattaatagtacaaacttcttactgccattttgtcgtttgttttctggttgttttgttggtcctctctctcatatatcttgtgatttaagcctggggtcattgcagctgtatcagcacttgggagcacactaaactcgggaatgatgtgactcttgcagaccccaagaggcactgtcttggtgggcttaagtaagataagagagaattccctagattaccccgcaaagcctgttactttccctctctttccattaattagaagcagcctgtctctccatgatgggctatctggagttaggggagaggtcatgtgaacactctcatggcctccatggttaggactgtgctgtgtcacacctgaagccagcacagtactggatcttgcccaagggccatggaatctattgcctagctaccactaatgtttattcaaggcccaagagctttttagtcagtaggtggtgaatcctgccaggactgggtccttcctttcagggttgcgattccctactggcccagggtgagtcaaggaatgccatccaggagctagggccaggaattaggcgcctcaggaatttgcttggtggtttattttactgtggctgagctggtatccacgtcgcaggacaaaatcctctgtactcttctctctccttcccccaagtggaaggactgtcttccttgagatgcactgcctggagttggggaaagtgtgacacaggccctatacatcatagctgctgttgcactgggtcatgcacagtccacgtccactgcctttgagaccagcacagcaccaggacttgcccaaggcctgcagtctttgtgccctgacagtcacttaagtttatttggggccccaggccacttttgttggctgatggtggagctgactgggacttgcattttttttttttttttttttttgcaagggtgcgtaagtaccctctggccttgggctggtgtagatgcaccgtggcaccagcagaattctgccttgtattatgttccactgtgatagggccactgagttctaatgcaaagacccatactcaccttgctctccctcctccaagcacacagattctctctctccacaaggcacagttaggggagagggaaggggtggtgtaggcaatgcaagactgtctttcttatcctcttcaatgcctcctcccttgatattatattaaatattgaaaccagataatttgatctcttacatgagtatttttttcctataaagttgctttcttgcgtggatagttgttcaattcagtgttccttgcagggggacgatcagtggagggttgtaatcagccatcttgctccacctccgtcctctaaactattttttaagactgcactctatgtgttttgtggtcattgaagtctgtgttttcttaacttagctagtgatttgacagaaatttccttagacactgagaaccaataataataataataataataataataataataataataataataataaatgacttcctggctctcctgcttctcctggttgaaagggtttggggtctagactcctcactcagcctctgccagtgctctgtccacagaggagggaatcatcacctcagactacctgtactgctggatggagttgaaagtttgagcccctcacttggcctcctctttcactgctggtgatggactgtttgtggtgtttggctagggtagtgcaggtattgtcaataagttttctgtctttctgggatgtccctttcttggtcctttggctagagagagcagacttttatttgggactttttttttgtctgcctctgttggtggttctttgttacaagcttttctaactcctagtttggggtatgggggaggtaaaaagaaaatgcagggaactccctgccatgttgtttcttaagtttcaaggtccctagccagtctgccttttcctttccacttatatgcaactttttataattttctgctgtggtttgtctagagttttaattgtaaaaacttgagaggaatggggaaaatgattgtatttcatcttgtctggaacccaaagtcctctgttatcttttttaaagagaggatcatatctttcttttccatccttactctttgtgtagcccttaagcattccagctgaaattttgggggtttaccagggacactgaccttactgggccccaaactccatgatactgctgatgagtagcttgtaatcattttaacatctttttttctgcttgagttctccaacacaaccatttagaaatcagtaaatgcctccttggaaaatgtggctcagactgtcagactcatttcttggctcttctgctttctcccggatcttggtttttcaaaacctgggttatataaagccctgaactttgatttttgtttcaccacctctgtgatactgtaggaaactgtgttccacttctctgtctcttaatcattgctttctgcttgacttttcagcctttctggctgtgttagttacttggtaacttaccagtcagcaaattctgacaggggttaagaagtatagtatatcaggctcacctcagcaagttttctttaactccaaaatcttggcccttcaaatcctatttgcgttggctccctggtgaaataacacacacacacacacacacacacgtgtgcacatacacacacgtgtgcacacacacaagcacacacacattttatggaagtattctagattttcttggtggatgagttggtctgttatataaagttgtccattatagccataagcagaaattcttcataaagttttacagttttcttctagtaaattttgtgtatattttgttatatatatttctaagttttatagtttttttgctaatatgaatggcttttttcttccattacattctctagttggttattgttgatgtttgcaaaggatattgactagtgtatttttatttattatttgtccatcttatagtaaactattattccattgcaaactaacactttttctcttttttctaatatttattcattcttttttcttagcttaattcattggccagaaattttagtactatattgaataaagttagtgttagcagccagttttatctccttcccagctttagagggactccttttaatgtttcactactaagtagaaagttttctgtagacttcacataaataaagtattaactcttataaaatgtccatcctatttcttcttatgttaatatagcttccaagttttcactaaaatgtaacctcctttattcaattttatactctctttggccttctcaaattatggttggcttcttcttcaagtggacaacaatacagtgcataaagtgttgtctttgatatttaattatgttttatggtaaatgttagttatgtttttgtctgtccccaggaagacatttttcctgttttatatttgtatccccattcttggtacagtatctgtcacatgctatatagtcaatatttttatataattaattatttcaacatttttatcataatattttacttccatatctgttgtatatctttattatcctgaaggtttctgattcgaagtaaaactgagacatagggaaagaaaggtgcatagggacccagtgctgcttttatgctcctgcttcattctcagttgacatttctctgaattatagattattagacttagaagtttagtcatcatctagtttgaccaattcatcttataaatgaggaaattgagactcagtagaggaagtgaaatgttccaaaacttacggctaatttaaaatctattccttaaatttatctgtgtagcaaaaagagattacatcacacagacaatcttgttttcgctgtatgctaatttccatgaatttcctagtgtccttccccaccttgacatgtagacagtgtgtgacggctggagggataagcattggcttaaggcgttggcacagtctgcagaatagagaaaagttttcctccatcagcttctggaataggagattctgctttagttcaccatttatccagatatgaacagtattccttacggaggtcctgtactattgtgtttcttcatttggacatatgaaagtagcctttgcttcttctacctgtggttgctttctagcttcagatatcatgctgcatttatatctgagattcttgaactttgaaataaagctgaactgtgaagctattgggaggggtatgtgggtgagctgaagaaggaggaagcagagaggattaatggctttggctgaaaccagaatgctctggacttaagaactacatggtttttgctcttcagagagctatagcagattcctaaatcccttagtgctggtttctacatggccttatccaaatctctatcctatagtcgctgttctcctacaatggtctccaagcagaccctttgtgaaattacatttcttgcaaatattcattccaagagcctaggccagccctgtgctacattggaggcatcaaacaacaactcgagcaaaaagtattcctcccactcccaatagtataactgaattttcgccatcatagaaagttcttccagaaatatttacattttaagtaaactatggaaatatcatttgaccaagagtcagaggttttcagttcagtcccttcttttacacttattagtaattggtttgtgagcaagtaaaaacctctttgtgttttagatttttatctgttatgtaagttgaaaaattcttaccttgcttacctatcatgattgtgataaggataaaatctgataatgaatggcaaaatacatcataagagcacagatataatttattatattaatgtaacatcacttgccgccacttattggatactcagtgcatgctgtgtactctaatcaatttgtagagtatatgtgtttgtgtgtgtgtgtgtgtatatatatatatatatatatacacacattaaatcatcacacattccaaaagaaagaactattatcctcctgttagagataaagagcctaagtgtattatctttctattgctgatgtaacaaactactacaaatgtaacagtttaaaaaaacacacgttttatatctcacagctttatagataagaagtctggttggctgacctgggtccttttcttaaagagtctcacaaagacgaagtcaaaatattgtaagggctacattatttttctggaggctctggtgatgaatatgcttgcaagctcactcaggttgttgacagacttctgttttacgtggttgttaaactgaggtccttgtttccttgctggctgttggccagagttttctttatcagctcttagaggtcacctacattccctggatcatgggatcccttcatcttcaaaagcatcaatggaggattgaggacattttacactttgaatctctcctgcctcttcctctgccccatctctctgatctcttactctgcccttcctcttttgcttttaaaggctcatgtaattatattggacccacctgggtaatccaggatactatatctattttaaagtcagttgattatcaactattccatatgcaaagtctctttggttgtgtaatgtttacatattcatagggataatactaggggacagagatcatggggaccaaaatcttgctaccacactaagagagccactatttaatgttattttattttattttatttatttttgagacagggtcttactgtgttgcccaggcgggagtgcagtggcgagatcacagctcactgcagcctccaactcctgggatcaagtgatcctcccgcctcagccttccaagtagctgggactacaggcacgtgtcacgatgcccagctaattttatttatttatttatttatctatttatgtacagatgggatcttttgcagagactctatgttgcccaggctggtttcaaactcctggcctcaagtgatcctcctacctcagtctcccgaagcactgggaatataggagtgagccactgtgcccagcctacttgtatttaaatttaatgtctaggttcctaaatgagtaaataaaactaatattaataaaacataaattaacgtgagaaaatattttatatatttcagagtgacgtgtgtgtatcctctttgctcaaaaagagagaacccctttccccagtttctctgcctcatattttcacttgcaatgttgaggtccccactgtatgttgtccattttagctcttcaacataaaggccttgattcatactacagaaggtggtgtttgtctgtctgatgatgtctttaccaaataggtaagtcactagggttcccttaggttggggctctaggggtgctcagaacttcaaagctattcctgtagagttttgcagtcttccttctagctattgcaaaatcacctcgctatgtctgactggatcctcttactcaatgtcccagcatcaatttcacttccaatcttgattctagtttagtctttttaaatccaatctgtatctagcaatcagaaagctctctctaatatgcaaatctgctagtgtgacagcattcttcagtggtttctcttttctctaaaaatcaaacctaaactctttgaagtggcttgtgagaccacacatgaactgtttctgcttacctctctggttttatttctatccactctcctcttatttctctttgcttcagaagtactgaactactttcatattttctagcctagtatgatctttggctccctttggtcttcatatgtgatagaaaattcttccgcttctttttattttttttaaaatctgagcttcaccagttcctactcagaaacttcccagtgatatcttcctctattccccaaatcatacttcataataattagcatttctttccagtaaactatcaaccccttaaagttgagaatccttattttgttgaatactgtgttgtctgaatttagcacaattgtaaaatattttctgagaacatgaatacatggattaaacttgtgtctgtttgagcattatactcacctagcctgagtggctgtgatggcacacctctattatcttaagatacttccaagaattaggactgagattgtctctttcctcagccctgatctgtgtgagtctttactagatagagtaggaagcttgcctcttgggaactagattatctgaccagaaattagttctccccaagccatcaatcaaattctttttgcttcttctgagaaagtaaaatgttttatccccttgcaggctgagtgcatattgatatatcatgactatctccacacacatcttggagacacattcccacaccatgattgcttcttttctgtgttccttaactgtaaccacctgattctcttccatgcttgtttgcttgtgtactatggtattctgagcacacaacatggttgtatgctttttttaaaaatattcttgagcaaatgtatttatttattggtatgtgcaatcacaaacttggtattttcctatgttgacattatgtatgttatagaatttaatgtttgtctaagtagaaacatatatcagcaaattaaatctgaattgtttcaaaacttctgtactttttatataaaaggagaaaaatatgtctctttcctaatagttttttttctatacccttcattctgttttctaagagcctcaggttgttagatgggtggcagtaacaaagagatcatagctagtttagaaccaatgacatatgggtcaacactgtcctccctctcataagaaccacagccaaaggctgggaagggccagaaaaatggtgaggttagaagttatttaagttagagcaattctctttagggtctgctgtgtcatctggaggaatagattggtggttctgaagtatcccttgtgggcctggcccttaggaacagaacagggctgtagagcccaaaaaaaaaaaaaaaaggtggaaaaactccagctggcagatataatatgaaagccaagccacttgagctatctgaccttattcagagcctaacccatttaaacaggacttaggcatgcttgggaatcttttttgtttccttaggctgaggcagaattgaaaccaagaggaaaggaggttgcagttgtggccacaagtagacataaaagctaatggtctgatcctgagggaagagattataactaaagtcacccaaataaagactgcagaatggccctgggccattcctaacagtcagggtagccttagagggtgtcaattgtgatagcccagcagcaaaggacttgatgacagagtaatagtgctgttgatgacattgtcaccaagcacctactacatgcttcaccttgggatagatacttcgacagtatcttatttaatcccgacagctcgataaggtggttattgtgcccgatccataaatgtgagaaatggtgctctgagagaagttgaagagacataataaacaggagaaatttctcctttcgtgtaagaaaattagaaagaaaagaaaaataaaataggggaaaataagtatattttagaaaggttaatggtcgaggcaaagtcatagatggatcattcaagattttttctcaatattgctgaatggctgaagtactaaatgtttattcggaatacaaatagtctggagtgaagaggactttaagagggtagtaataagtagagtttgtttactccccgagatctagagttttgatgtgatcaagaacatttcctacctgaagcataacctgtcacctgtggcttctgcttctgttagaaatagcatttgcaggatattctaaaaaggaaaaagatttttgtttggttatcaggttgaagagaaatcttaaatgaccataggcagggtgaccatatgtctactatagtcctggtttacacctattatcttggcatattaaagtttgctttttccaaagtgtccaagttttggccataagttatttgatcactgaagccacagaaggtgtaaagagtgtggttctcacaagccgtctcttatagaagccaaatatgccttcactcctcagtgcatttccctgggaccagcttctgcagagattgtatgcctttagacttagggtaacctactcttgcaccatggcctttggctcacacaccaatgctgtgttaacatgatatgttgcgtgattctatggttatctttccctgaagtattgccctttgtcactgtaatatgattctgcatgcttaggtatccaagcaagcaccatggccttctgatcctgaattataagtatctgctcctatataagaagagtttatgcacatgaacgtgaaccatgtttatgatgtcatatgtcatgattttcaagcatgttagttatatttgcccatgtatcaagccagagccagtgacttctgtgttaggtgcaatttaccttgtttaaagtttatctgaacatttaccatgatggtatacacctgtcccggagcttaaggctattgtgttgtgatttccaactcatgaattattttcttggcatgttgcattgtttaacatatcaatgtagtatcctcatgtacaatgttgactatagtcacaaggtatttggatgattctactactctctacttctaataatagatgattgtgagcacactgtactatggctgtcagttcatacatcatgacttcctgataatatttaggggttttctgagtgtgatttttgttcaggtggtaaaactacagggggagatatttatacaccatgcagtcatttaaacatgtctcagagtccttttgtaacaatgtcatctgtatttgtttcccaaggatgccacaacaaagtgctttaaactaggtggcttaaaacaacagaaatgtttttctcacagttctggaggctaaaagttctaaatcaaagtgtcagtaaagccgtgctctctctcgagcctagcaaaggagtcatccttgcatttttcagcttctggtaatcccaagtgtttcttggcttgtggcagcatcactccaatctctaacttcattgtcatatggttttctctcgttgtctgttatatctaaatttcccccttcttataaagacaccagtgattggatttagggctgaccctaatccattataaaggcatcttaacttgattacatctacaaagaccctattaccaaataaagtcacatccacaggtactgggagttataacttcagtgcccctcttttgtagaacacaattcaacccataatagcatttacatttggagacatttgcttttatgttatagcttttaaattaggcatgtgttcatccgaggaagcactacagcttagttctctgttcatatatcactgatgtttgagattgatctgtgattgaccaacttctatgtcatggttatcacactgtgcagcatgttactagctcatatatcagtcatgtcgggctcctacttcaacattgctttttgctcttgtactatatccaactgttcctgtattttgcgtatttacagcgatatagtcttgggatatagtcttctctattatcattcattacctcacattttatggttgttaagttgtgcaccatgatcagatgctcaaacaaaagagccatctgagcatatggcatgaggtgtcattttgcaccactgtcatcttatccttaactgaaaacttgattcagtattgtggatatcggatagggacatgcgtctgaatggataccactcctgaaggatagccaactgcttgtgtattttatgtgtatactaattgattctctgtgtatacatcatagatattgctcacccatcattaatgtgtaaaaaataaacataatctccttctgtgtggagaatgataactttaataacatgaatattagttcctgaattgtggtcactggctcctgcagaatgggtattttctccatatttgctgtctgttcctgtatcatgcttactaactgtatcatagctgttagtttgtgtaatgggatcgtttggatttatatcatgcccaaacacaaatgtgtagagtcaatcaccatggttattttttttatgagtcattatgtccatgtgagtcttttttttgtaccactgtcatcttctcttgggccaaagtcattaattgcttgcatggttatttttgattacataccatatctacccaagtaagaatcacaccatgttttatttccatatcatgtccatctgcacctgtgtcataattgatagcctatgtcctgtaggtgtctgactggacctcatgaacacatattaaaacatgctttttggcatcttattcatctgaacatcctgtattattttgatcttctttttgacaaaatgccatacatacccgtattttttgtatcacctgagcagtttttactctgtgattctttcctgggataccatatctatcccctttttcatgtatgaattgacctattctccatgataatataaacatacataatgaatttgtgctcatatactgtgattgaagttgtactacgtatttaaacttaaacaccacacttgtgtgaaaatacacaatcattgtctacttgtactgggaatgagtattttgtactatgtatattaatttctacaccatgtctttcactattgtgatgagttttctctgtcctttgtcatctgtctactccctataacctggtatcagctcatgttgcagatcttctgtgtgtgcatcgtggtcaaatgctcagactcctgtggtggctgcttatgcaccacggatgtttgagcatgtgctatggtgtctacttttgcaacattgccatctgcttctggaacaaagccactcatttttctgctctgttttaaaatctggtatcatgtctgtcagaagaatcacagcatattgtcatttattgtcatatttacaataatggatagtggagccaaaatgactgaatttgaatcctggattatccacttactagctatgagatcttggacacatcagttcatgaaatggacacatcaattcgtatcttcatgcttcagtttcctgcaaaatgacaaaaaaagtagtaaggttattgtgaggattgtataagctattatacataaaatatttttaatactgcctggcaggtagtgatgatgatgataacaatgatgatgatgatgatgacatgacaatgatgataatgatactgtgtcccttgatcgtgtataataattgtcagctcaaattctggagttctctaagtgtgcattatggtcaaatgctgatacttgtgatagtgtttaaagcatcattatataagtatatgccatggcagtcatttgaatcgttgccatctgtagtattctattagctactgcactatcgttttctgctattttattatcagcatcttcttcaatatccttgttcatctgctcctatattatggtcatcagcttatttttgttgggatatctgggtgtacatcgtggtttaacagtcaaatattagtgttagttgctcatgcaccatgattgcctgagtatgtgccatgatatctcctccagcatcattgtcatatgctgtttgcctaaataagttgtattcatgtgttatgtttcctttattcatatgtcctgtccatctgggcatattcctcattgtgttattcactcttgtatcacacccacctgcttttatattgtaggtttttgctcatgcaccatggttgtctgagcatgcagcatgcttgtctgctcataccccatggtttctgagcaggaaccttcattgtctactgctttacagggaaatagtgttttatgcatcgtgtatatgagtttagtatttactcatattctatgactctctactcttagatcacttctgcctttttctgcacattgtttatctgttccaaaaagacagatgttatctcatgtcactgggctttctaattgtacatcagtcaaatgcttaaatgcctatgatgtgatggctgttcatgcaacatggctgtttcagcatatatcataacttcacccgtttaatcattgccatcttctcccagactaaagaaaataatgatttttaatcaccaaccatatccgttttggtaatcatggtttcatgtctacctgctcctgtatcattcttttactttatgtcgtgggattgtgtaggtagccatcatagtcaaatgcccaaatactagtggtggctgttcatgcaatggtcatctgagtatatggtgtcaggtctcttttgacatatctgacatctactcatggacaaagctgtttacccctgtaccgtggctcttgtataaggcacaatatctgtctaagtaagcaccacagcatggttttattctccgaaaacaagtttgtgtgctgtatctatctatgcctcttagctcctttggcataaatgctacgtaatagtgtaaactacttttgtgtacctgtgtaagtcaagatcaaacagtcaaatatcactaatggctttcatcaacttttgtctgaacatgttacacggtgggtcctctatgcacctttgccacctacatttgaaataatcattcatgtattgagatgttttgatcttgtactatatccatctatgaggtctccacttatgattattttctcataagatgtctcttggctctaagtgagccctggctaattttccatggttgtatgaatgtgcttatgccctttagctatggtcttctgctcattcatcatgatttgtgaaaatgcaccatcgttgtctacattgtactaaaaatggaattttctgtaccatgaatataattttgtgcaccatgattttttgtcatacagtgtgtttgcctccttcttcgtcctcagtatctactcctatatattggatgtcagcttctgttgcagaacctgagtgtgcatcgtggtcaaatgctcagactcctgtggtggctgctcatgcaccacggatgtttgagcatgtgctacggtgtctacttttgctacattgccgtctgcttctggaccaaagccatttgttcctgtgctctgtgtttctaatcttgtatcacatccatatgaggaagcatggcaccatcagtgtatgtgcacaatgctcactgcttggacttaaatcccagttctcctatttaatagtttgaaattcttgaggaagtcatttcacccttctgtttctgttttctaaactgtaaaataaataataatacctcatagagttgtgaggattcaaagatgcacatgtagaatgcttagattagtgcctgacacatataaatgataagtatttgctgatattgttatattatttgtattatgtctctttattctttatcatgacttttagcttgcattctgagaatgtctggttgtgtaccttagtcacatgctaaattactggtggtggctgtccattcagcatggtcgtctgatgttataccttggtttttccttttgcacatataccctttactcctttggcaaagtcattcattgctgtgttgtatttcattattcatcgtgtctttctgagaaagaatagcacagtagttgactactattctatttccacctgtacctgtatcataattgatagctcacctttcagtgtatattggtgtgtattgtggttaaattctcaaacaccagtggtagtttttcttccatgtgatcattggagcgcatgtcatggtgtctcctaccattgccatctcctcctaaaccaaggaattctttcccgtattgtggcttttcgattatatattgtgatcatctgtacaatttcaactatgtggctattttctttgtgtcatgtctgttttcttttatgtgtaagtattggctcattctccatggtagactgagcacgcgtaaggaatttctgctcatatattgtgtatggggttgtactatagactttcgctcatacactatggttgtgtaaaaatgcagttgtcattgtctactcctgaactgataaaaggatggaatcatctgtatcatgaataacagtttgttaattttgacagtatcgtgtttgcctgtgcttctgccatcctgaatgtcagttcatattgcaggattatctgagtgtgcctgtggtcaaatgttctgactattgtgactgctcatacaccaagaatgtctggcaatggactatatatttatttatgcaacaggaattattgtctctatcagcaatatagccattaattcctctgttaagcatgtgttttttaatttaccatatccattagaggtagcatagcaccactgatatataataagggtagactgcattatatacaaatcacttttttttgtttttccctaaaataataacatctacctcatatgcttgtttttttaaagtgcttagtgcttggtatgtaataagttctaaataattataatttttaataatatcctcatcatcgttatcatcgttattatactagaattttttcttcattctctatcatggttggcagcctatgttctgggattatcttggtgtgtgttatagtctaatggttaagcactggtggtggctttacaatgcacaaatgttgtacaaccatttgccttgatgtcatctatagggccattgccatctgctcctggactatttcatgccatcttattttgaaaatattgtaccatgcccctctcggtaagtaccagtctatggctttcttgacctaccatttctaatttttcctcaaacatacttgtatgtgcatcaccatagttatctaatgtgctcacataccatggttttctgcataaggcataattgtgtctactgttgtaatgagatagccatcattcatgttattgaaataagtttatatatcaaatttatttcatttgaattccctttttatggtttcctgtcattgctgtcagtttctgtatcacatcctttagctctgtgtccttactctcagcatacactttatagttatctgattgatgactttgacgagctgagagaagaaggcttcagacgatcaaattactctgagctatgggaggacattcaaaccaaaggcaaagaagttgaaaactgattgtatattagaagttcaaacaccaggaatgtttgttcataccacattgctatttaaatatatactgtgttgttttactttttactattgccatttactttgcccccaaatctttgttcctgtgttgtatttttttaatctcaaatcttatccatgtgaacaagctctaaacgatgtctctctgctcctatatttttttttatcatttaccatgcttcccttccatgtaccatatataaaaaatcacaattttctaagcatgagccattatagtttgatcctgcaccgaaaatgccatcttctgtgtattggactatgtattagctgatgcatgatggtttttaggtccggcactgaggtattcttcccctccatcagtgttgtctccttctatatcatcttctcataacatagtcaagagctcattttgcagttgtcttagggtacattgtgatcatatggtattcatgatctccttttgcatcattgccatctgctacattccttcatatatcaattactgtctgcacttaggctgcatagatgtgttcttgaatcattgctatctcctcttatatagctgctgtcatctgattatgcatcacggtcaaatcctcagcctctagtagtgccgcttcatcacgcagcatggttgtctgggaatgtgccgtgggatctccatttgcattaattccttcagctcctggaccaaagccatttttaaaaattcatgttctgtgtatcacataacacagtatttgtgattgcacctgtactatgtccatttatttctgcatcatggctacttcctcctgtttcgtaagtttcaattcataatctgaggttgtttgttatgtatcatggtcaaattataaaacgctgttgatggatatttatgtgctatggtcttcttgatctatgccgaggttttcttttttataccattaccctctacttctggaccaaagctactactttctatgccttgtgtgtgtttaagtcaagcaacacatatacttcagtaagcagatcattagtgacatctccttctgtcttaagttgtagagttgtgcatatttactatgtgtatctatgcctgaactatgattgtctactatagtactaagaatgaagtattataagccctagatggttagctcatataccacatttgcctgctcttctattaccattcttttcctttttcatctccaaatgtctactgttgcatgccttgcagcaaatgtggcagagttgtttgagtgtccattataatgaatttttcaaacttaagtgatagctgttcatgtaccctgtgtgcttgagcatgtattagtataatcttttgcatggttgcatctgatcctgaagcaaatccatttgtttcataattttaaaaatacatgcagtatctgcctgaataataaccatcctatagttgtgtgctccagcactattatgacatgtttcatgatttaatgacttcatattattggtgaaaacatcattacttcactatggatatctacttatttaccattgcaaatttagtattcattctaaatagtagtgttcttggaatagtgatatcttctcataaacagtggttgtcaacttacgcattgtgaatatcggctcatttatggtcagggttatctgaacacatgcagggtgagaatctatagttggctactgattattattatggaccactaagttatgcaattcaatggtaatgctcttaagaatgtttatttgtccactttgatgatcatacatagaaaatacaccatgatcaggtgggcactcattgattgaacgctcctgtgctatagttattctctttgataatatttgtttcaattccattctctgttttcattgtattacgacattggacaagacactctatctctttgattgaaaacttatatttctgggttatatatcctgactttcaaatatattaatatatcatatacatttttccacataaaatagttctaaaatgtaattttcacctgtataatatttagatgtatcaacgaccattgtttatttaaccattctgttagtatgcacattcaatttattttttaaaatttaactaatatactgttatattgcagaaaatatatttgaacatgacttttttgaatctttggtttttttctgtccagtagattcctagaagtgcagttactgagtcaaagcatggatttttttttacaggctttttattcatgctgcaagattgtttacaaggaaggaagcatagatttacgctcacactagcagatatatggaattcttgtctcgtcctatcttcaacagaattgtttagcatttttttaaaaagcttttgttcatttgataggtggagtgatgccttgttgctttaattgcatttcttcaatcaatcttaagactaagtttttaaggatatatatcaatgtaatcaacaatctgaaatttttattattcaactgtgcataggacttacttttctgtgttttagcttaaaatatgaaacactatatatgtaaatataattatcacacaaagatgcacgctgttttagaataattaagaagtgaacacctgtagaaccactaagtcaacagctataacattgtgggtactccagaagcctgtaacgaacttatttctaatttcaaccttttctttcccactttacttccactatccttaatcttacttttaaaaataactttattatatgtataacaaaatacactttagttttgctgtttttgaactttatatgaatggaatcatgattttcctttgtggcttctttattattattatactttaagttttagggtacatgtgcacaatgtgcagcttagttacacatgtacacatgtgccatgctggtgtgctgcacccattaactcgtcatttagcattaggtatatctcctaaagctatccctcccccctccccctaccccacaacagtccccagagtgtgatgttccccttcctgtgtccaagtgttctcattgttcaattcccacctatgagtgagaatatgcggtgtttgattttttgtgcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtaaatagtgccacaataaacatacgtgtgcatgtgtctttatagcagcatgatttatagtcctttgggtatatacccagtaatgggatggctgggtcaaaaagtatttctggttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggtttcgatttgcatttctctgatggccagtgatggtgagcattttttcatgtgttttttggctgcataaatgtcttcttttgaaagtgtctgttcatgtccttcgcccactttttgatggggttgtttgtttttttcttgtaaatttgtttgagttcattgtagattctggatattagccctttgtcagatgagtaggttgtgaaaattcatgagtgaactcccattcacgattgcttcaaagagaataaaatacctaggaatccaacttacaagggacgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactgtactacaaggctacagtaaccaaaacagcatggtactggtaccaaaacagagatatagatcaatggaacagaacagagccctcagaaagaacgccgcatatctacaactatctgatctttgacaaacgtgagaaaaacaagcaatggggaaaggattccctatttaataaatggtgctgggaaaactggctagccatatgtagaaagctgaaactggatcccttccttacaccttatacgaaaattaattcaagatggattaaagacttaaacgttagacccaaaaccataaaaaccctagaagaaaacctaggcattaccattcaggacataggcatgggcaaggacttcatgtctaaaacaccaaaagcaatggcaacaaaagccaaaattgacaaatgggatctaattacactaaagagcttctgcacagcaaaagaaactaccatcagagtgaacaggcaacctacaaaatgggagaaaattttcacaacctttgtggcttcttgcttgttaatttaatgttaggtttgtgagatgtgtacaggttgttgcatgtaattgtagttcattctgtttcattgtggtatggtattcctttgtatgaatacagcacaatgtattcattctattgtaagatagaccttcagattgtttccagttctgtttttacagaacagtgtttctatgaacatgctttaacaattatcctggtgcatcaatatatgtttctttaacatatatgtctaacagtagaaatagtacatcatgtatatgtgtatcatcaaatttatagtctaatgccaaacttttctccaaagagtttgtaccattttatactcctacctgaagtgtaagagatctcttgtgcttcattattcttgccaaactttgtattatgagactttaaatttttttgtcaatcaattagtttgtggtgagagcttattttctaatttctaatttctaaatttctaattttcattatcatgattattaatgaggcaaacactttttcttatggttaatgacaatttgaccttccttttttgtgaagtgcctttttaagtcttttgtccatttttctattggattttctctctttttcttatgatgttgtaggaattctttggataatgtttctttatcagatatacgtatgatgtgtgacaaacgtctaccattcggtatttgttgtttactcactttcttgcatcttttaatgaacagagatctgaattttaatgtagtctgttttaacagttgcttcctttataggttatcactttgtgtaagtttaagtaatattctcttactctgtgaagaagttcatttctattgtacaggctttatcattctgcctttcatatttagatcttcaatccacctgtaatacatttttgtatactatgggtaaggttacaatttaattttgtataaattttgaaaatagcaaattgtcctacaaccatttattgaaaagcctgtatttgccagaaagtctttggtgctactttagtcacaaatcaattgtcttataaacctatatctatttctgaactctctattcaatgccatttgtttatctcttctggcaccaataccctctgtgctaattaattttttttaaatagtcttttttctatttctctgaaaaatgtcattggtattttggtaaggttttcattaaatctgtagatcactttgggtagtatggagattgaaaaacattaattctttcaatttatgaacatgagctatctttccatttatttgtgttttcttcaatgtctttaatcagtgttctatagttttcagcatacaggtcttttacctacttggctgaatttacaccaaatatattatttttgttgctgttataaatggggttgttttcttgatttttctttttgggtagttcattcatagtatgtagaaaggctcctgatttttgtaagggtattttgtatccttcaactttactgagtttgttaatcagcttggataggtttttctttttttttttttttttgtggtggagtctgtagggttttccacatataaaaatcatgtcatcagtaaccagagacaatttcgcctcttcctttccattaagaatgctttttaactctttctcttgcttaattgctctggctagaaattcttttactaagctgaaaagaagtggcaagggtgggcatccttgtcttgtttctgatattagaggaaaaacttttaacttttcgctgtcgagaatgatgttagctgcaggtttggcatgtatggcctttatcgagggtttttttttttttgtaatcaagagagtgttgaattttgtcacattctttttctaaattgattgagatgatcgtagggattttaccctttgctttcttaatatggagtattataaatttttgatttgcatatgttaaaccatctttgcattctagtagacataaatgccagttgatcatggtaaatgattctttcagtatgttattgaatttgctttgctaatgttttgttgaatggttttgaatctatatttatcagggatattggcctgtaattttcttttcttttctttctttcttttttttttttttttttttttgagatggagtctcactctgtcacccaggctggagtgcggtggcgtgatcttggctcactgcaagttccacctcccaggttcgtatcattctcctgcatcagcctcccgagtagctgggactataggcgcccgccaccacacccggctaatttttttttgtattttcagtagagacagggtttcattgtgttagccaggatggtctcgatctcctgacctcatgatctgcctgcctcggcctcccaaagtgctgggattacaggtgtgagccaccatgcctggctggcctgtaattttctttgtatgtgtgtgtgttcttgtctagctttggtattaaggtgttgaaaaaaaatcattaaatttatatgatactacaaaagatccagaatagccaaaataatcttgagcaaaaagaacaaatgtgaaggcatcactgtccttgatttcaaagtctattataaagcagttgtaatcaatcaaaacaatatggtactggcataaaaagagacacatcaaccaatggaacaggataggaagcccagaaataagcccatatgtttatggtcctttgatttttgacaaaggtgccaagaacatgcaatgggtaaaggatggtctctttaataaatagtgttgggaaaactgaatatacacatgccaaagaatgaaattggaccctcatctcacaccatattaaaaaatcagctccaatagattagagacttaaacataagacctacaactataaaacaactagaaaaaaacatgagatgagaaaaagctctatgacagtggcctgggcaatacttttttatctatgaccccaaaagcacaggcaacaaaagcaaaaatagacaagatgccatcaaattaaaaagtctctgcacagcaaaggaaacaacacagtaaagaggcaactccctttatggtagaatgatttacaatcctttgggtatatacccagtaatgggattgctgggtcaaatgatatttctagttctagatccttcaggaatcgccacactgtcttccacaatggttgaactaatttacactcccacaaaccgtgtaaaagcattcctgtttctccacatcctctccagcatctgttgtttcttgactttttaatgatcgccattctgactggtgtgagatggtatctcattgtggttttgatttgcatttctctaataaccagtgatgatgaactttttttcatatgtttgttggctgcataattgtcttcttttgagaagtgtctgttaatatcctttgcccactttttgatggggttatttgtttttttcttgtaaatctgtttaagttctttgtagattctggatgttaaccctttgtcagatggataggttgcacacgtatgtttgttgcggcactgttcatgttagcaaagacttggaaccaacccaaatgcccatcaatgatagactggataaagaaaatgtggcgcataggcaccatggaatactatgcagccataaaaaacaataagttcatgtcctttgcagggacatagatgatgctggaaaccatcattctcagcaaactaacacaagaacagaaagccaaacaccgcatgttctcactcataagtgggagttgaacaatgagaacatatggacacagggaggggaacatcacacaccagggcccgttggtgggtggggggggttaggggagggatagtgttaggagaaatacctaatgtagatgacagtttgatgggtgcagcaaaccaccatggcacctatgtaacaaacctccacgttctgcacatgtacctcagaacttaaagtatacataataaaaaagaaacaagtatcaatatgactaaataaatgcttaaatatattaagaagagacaaccccgtgaatgagagaaaatatttacaaaccatgcatctgataagaggttagtatccaaaatacataaggaactcacacaactcaatagcaagaaaacaaataactggatcaaaaaatgggcaaagaacttgaacagacatttctcaaaagaacatatacaaatggcaaacaagtacatgaaaaaaatgctcagcatcactactcttcagggaaatgcaaattaaaagcataatcagtgtcttagctaattttgtgtttctataaaggaatacctgaggctgggtaattcataaagaaaagaagtttatttagttcacagttctgtaggccgtgcaagaagcatggtgtcagcatccactggctgctggtcagggcttttgtgttgtgctgaaatatgacagagaaagtcaaaggggaagccggcatgtgcaaaaggagatcaaatctgaggggtgtcctagctttataacaattcactctcctaggaacgaatctatttccccaagaaccaatccagacttgagagataaagaattcactcactactgctagaacagcactaagtcattaatgagggatctgcccccatgacccaaacatctttcactagaccccacctcccaacactgccacactgggcatcagatctcagtataagcttggtagggctagacaaaccatattcataacatagcaatgatatatcacctcacacctgtaaggcaggcttttataaaaaagatgaaagataagtgccggcattaatacagagaaaagggaactcttgtacattgttggtgggaatgtaaattacattatcaaaaatgatacagaagttcctcaaaaaactaagaatagaactacaatatgatccagtaacctcacttgtgggtatataccccaaaagaaggagatcaatatattgaagagatatctgcactcccatgtttgttgcagcactgttcacaatagccaagatttggtagcaacctaagtggccatcaacagatgaatagataaagaaaatgtggtatatatacacaatggaatactattcagccttaacgaagaaggaaatcttgccatttgtgacaatatagatgaacctgaaggatactatgctaactgaaataagccaggaacagaaagaccaatagcacattctcttttatgtgaaatctaaaaaagttgaattcatagaagcagagtagaatgatacttaccagagattgggtggggtagagagaaaggaatgaaaagttgttgatcaaagggtacgatgtttcagatagacaggaggaataggttttgagatctattgcacagcagggcaactgtagtcagtaataatgtattgtatatttcaaaatgaaggagtaaatttcaaatgtcttaccataaaaagatgataggtaagaaaagtgatcgatatgttaatcatcttgatttaatcattccacatgtatatgtatatcaaaacatcacatttaaatacaaaaattagccaggcatggtggtgggcgcctctaatcccagctactcaggaggctgaggcacgagactcgcttgaacccgggaggcagaggctgcagtgagcctagatcgcggcactgcactccagcctgggtgacagagcaagactccatctcaaaaaaaaaatcacattgtaccccataaatgtatacaacaatgatttgtcaattaaaaataatatcagtcctgatatttggtaaagtccttttgccttattcttcaaaacttcaagaggctattgtttgctttgcatttccatataaattttggaattcctttgtcaaattttatcaaccaatcaaaaaataagcccaaagaaaaggaagatgatagtaaatatctattatgttattttctatttcaaaaatttatcatcatattttaattatcatcttctttcttttggggctttaattttaatctcattctttctgattgaactaggtgcttagctcattacttttttttaaatctttttaatatacgtgtttaaggctacatggctttccttaagtactgtgtaagctgtatgccataattttgatagcaattttgttattgtacagttaagaatatgttctaatatgtattttgattttatttcaccatgagttatttagaagtgtgtttcttaattttcaaccacttatcaatgttatcattatcacctaattactaatttctaccttaattgcatgtggcaggataagatatcctatattattttaataattgaaatttgttgtgattttctttatagccttgtacatttttgtaaatatacctagtgagattttttaaatgtgtattttcttttgccatcaatgggtatggtattctccatatttccatgaggtcagatttgttactcgatcttgttcaaatcttctgtatctgtcctaacttctttaatctctctaatacgttaatttctgaaagagatatgttatgatgagagacatctatgttttgtgtagttttgttaattttgatttatatattttgaatcttcattattaggtgtatagaaatttattatatctccctggtaagttgaaccttttttctcattacttctagtaaaacctttcacatgaaagtctttatttcttattaaaaaatagaggattttttggttaataattacataacatatatactgtcaacttttctgttttcttatgtgttagatatgactcatgaacaatatgtagttaatttagttttaatcacttttaatctttctgataacttttttatttgcaccagagcctttagttcctttacatgtaaaaaatcgccgatatatctgggtttgaaactatcatcttcttttaatgctttctatttagcttgcccattttatgttcattttccttttgtgtgtgtgtttttttcatttatttattttatatttggatcgatagctttaaaatcattttttctcctcttctaatatagaagacatacagtctatttttatttagatttagtgggtgtcttagtaatacacacattttactttctaaagtctttttatatctggaagttgtatttgattctttaataaaatcatctagtttattgtttaaatatcctgtactctgcagatattttaaacttcttttggtggaggtcctaaaccttttatataatatgcacctgataaattcaatatctgaagtatggggatttgctttctgctctagctgtttctgttgtttctctctcattgtgcctagattcctcgttttagtgatctttctctgtataccgaccaatgtctgcgaaaaattatttatgggggtttcccaaagcctaatacaaaaatgtcattttctagtgatgatttatgtttacttctgcaggtcacctgaggcagagtttgcaggtactttaaattaaattcatgacttgagatttattggatcaaacattaatgtgaatttgagttgcaaacttaagagagtaagagaggcctgcttgtggtttaaaaccttttgcagggggatcgttttgtctgttttatttgtctcaatttgtctatgccctgttcaaactaaagcaactctcttgcagtctcctggggtttgaagaagatacacaggcatgcttctgattcatcaataatctgaaattgtagcatgtgtttgtgtgtatgtgtgtgcatgcatgttgtcagactccacaccacttgaaaattctaggctttggtttatgcactccttgctctatgaggctgtcaaaactacaacatggtttggtagctctgtatttattttctcttacttttccttggattgctgtttttgttttcttttttttaaaatttccttaggttgtttttttttctctcttatttaatcataaagacattgagtaatggcaatttattaatttatccatctgtacagttttgggtttattctccccaaaataaagttttgttttatagttttgctgccttaattattcttgagatggtgttatttagagaacaaatttcaatttctgtttagtctgttgtgttaattatgatgtttgaatctgtcttcatatttgtcagcttagtcattgcaaactgagtgctgtgttaatttacattaacacccgatttctttcatttatcttttatttctaagattttattttatttagtctgcagtattattattgaaagcagaaggttttatgagttgttgctaatagtggggatggataaagaatagcaactatacctatatatacctcacagaagagtacagtacaaaatatattaatcatggaatgaccacatacattttttgctagttcagcccctaggtttctaaattacggtgtttatgtgacattggtttgtcttttcctaacagtctttgggtatttttagaagatgaaacatgtgttgtatagtacaagaatgtttatctgaatccattctcaatagcaatgtatataatcaaattcccttttagacattggatttttgccttttttccattattcttgacaatcaaacttccttccacccactgttttctgttattcctgtctctcttaatgagaatttcagaggtgatatattttctgttgtgttaactctgaggcaaggagccccaaattagaggtatccatatagaaacccacaaaaatattgaatagaaatagacagaactgcagtgtaattagattggtatcattaaattcagtaaggaagaaggcagaatgtagatgattaaaaaataaacagaaggcaattaagctggagtaaacaattataaattactagttcaagaaacttgattgataaaagaaagaaggtaacagctagaaagaaacatattggtagaatttctcttacagtggaagaaactttattatgtttatagtctaagagaaaggagtcattagagaacaagagatttaagatataggtgagaaggagagtcgatggaaaggaaaaaagttcatgaggtcaggagcttaggttgagagattatcctaagatagggaaggttcacctcattttctgaaacaaaaagaaaaagtaaggataaatataaaagtgagttaattttgtaggttgagacaagctgatgtcttaaattgggtttcactcaagcaggctcggagattaggattcatatgaaggtagtttattgggaagtgttcccagaaaaaaaaaataagagttttgggaagtggggcaaggaagtgagggtggccaagcaagggtaatgtatcaagcaaagtaccatggaaactgtgtgggtcacacctcactgttgcccctatcagggagctgcattatttgtacttctgtatctgtcagtcttagtttagggctgccctagtttggaaactcaaattctcaggcaattctgattgtcagtgtgcacgggcaaaagttagtttcagcaacctgaggacagctctaatcctcagacaaagaaatgcagatgctgccttttgggcgggaaggctcaatggagtcaggatatgtgaaactggtgaagagatccaaggggatatgaatgaggcattaataattagctagtgtctaatatgggtggtttgtctcttctgatcatcttgactttgtactgaaagaatatactagtttccctaaataggcaacttgagaagaatgacaaaggtttaaaatagttgagaggaatagggaagaggactggtttatgacaaattgaaggattattgaagaatgctggtattggaaataatgaatttattgtggaattttcttcagctgctttcatcagtctaagacaaaacagattgtttgtggattgatcccaaatagggtttctagacaaatacagtggaaggtcatatgaacaaggtgctgaaagagtagtccaagtaatttactttggatccagccttgaaatgaaaggaagtaacactaggcaagtccaagagcctgggtgacaatgaaaggatcaacagactagaacactaatttcaaagagcaagtggagtagaagtaaaagtttataaactagaagaataacagaataaggtcaaacatcaaataccatagtttaatatttgtgatataggagcaattatgcataagatacagggtgtgattgaatggaagagaaagtcatagagattgtgcagatcaaataactatgatagatatattatctacacaaacagtgaaatactgaaaatgatagagggatatgaaaagcatgaattggttattgtagccttgtagtatagtttgaagcggggagtgtgatgcctccaactttgttctttttgcttaggattaactatttgggctcttttttggttccatattaattttaaagtagttttttctgattctgtgaagaatgtcgatggtagtttaatgggaatataaattactttgggcggtatggccattttcatggtattgattcttcctatccatgaacatggtcctggcacaagaacagacacatcgaccaatggaacagaaaagagaactcaggaaaaagaccacacacctacaataatctgatctttgacaaacttgacaaaaacaagcaatgtggaaaggatttcctatttaataaatagtgctgggagaactggctagccatatgcagaaaattggaactggaccccttccttataccttatacaaaaattaactcaagatggataaaagacttaaatgtaaaaccaaaaactataaaatgaagaaaatcctagaagaaaatctaggtaataccattcaggatataggcataggcaaacatttcatgacaaaaacatcaaaagcaattgcaacaaaagcaaaaattgggccaagcgcggtggctcacgcctgtaatcccaacactttgagaggccgagacaggcagatcacgaggtcaggagatcgagaccatgttggctaacacagtgaaaccctatctctactaaaaatacgaaaaatcagccaggtgtggtggcgcgtgcctgtagtcccagctactcgggaggctgaggcaggagaatggcgtgaacctgggaggtggagcttgcagtgagtggagattgtgccactgcactccagcctctccagcctgggtgacagagcaagattccatctcaaaaaaaaaaaaaaaaaaaaaagaaaagaaaagaaaaaattgacgaatggtatctaattaaactaaagagctcctccacaacaaaagaaactatcatcagagtgaacagacaacctacagaatgggagaaaatgtttgcaatctatccatctgacaaaggtttgctatatagagtctacaaggaatctaaacaaacttacaagcaaaaaaccccattaaaaagtgggcaaaggacatgaacagacactcctcacaagacattcatgtggccaacaaacatatgaaaaaatgctcaacatcattgatcattagagaaatgcaaatgtccatcaatgatagactggattaagaaaatgtggcacatacacaccatggaatactgtgcagccataaaaaaggatgagttcatgtcctttgtagtgacatggataaagctggaaaccatcattctgagcaaactatcccaatgacagaaaaccaaacgccgcatgttctcactcatgggtgagaattgaacaatgaggacacttggacacagggcagggaacatcacacaccggggcctgttgtagggtggggggatgggggagggatagcattgggagaaatacctaacgtaaataacgagttaacgggtgcagcaaaccaacacgacacatgtatacatatgtaacaaacctgcacgttgtgcacatgtaccctagaagttaaagcataataataataaaaaaaaagaaatgcaaatcaaaactacactttgagataccatcttacgccagtcagaatggcgattattaaaaagtcaagaaacaatagatgttggcaaagttgcagaggaaaaggaatacttttacactgctgatgggaatgtaattagttcaaccactgtggaagacagtgtggcaattcctcaaagatctagaaacagaaataccatttgacccagcaatcccacttctgggtatatacctaaaggaatataaatcactttattataaagatacatacacgtgtatgttcattgcacacatggggaggaacaatatacactggggcctctccacagtgggttgggggaagaagagcatcaagaatacctaatgaattctgggcttaatacttaggtgatgggttgatctgtgcagcaaactatcatggcacatgtttacctatgtaacacacctgcacatcctgcacatgtaccctggaacttaaaataaaagttgaagaaaaaatagtatacagaaacgccacaaaaagatagaagtatgaactgagcatagtttccgaatcagtgtcgggaggcttcaaggaggcagacgtaagattgaaaggcagagagtgatacagataggaggcatgaacctcaaataagaaggactgtggtgcacatgcatagatgagagatggtttcaacgtggcattgaaaaaatgagatagttctcatcttgtctctcagttgcataatatatgggagtatgcacatgtcacacttcaggggaaagttaatgaagtagtgtctataatataaatcccaatttatttaaggcaaagagaacagaaaagttttcctttaaaaagttgagagcatagaataatttgttttccataaaatgaaggattgaaagggcatgggggaaaggttttaggaaagtagcatagtcttgagattatacctctgagaagaaaaggatgcccagagttgtgtgagcatgaactcatgaaaaaattcactctttttttccaacaaatattttattgagtaacagtcatgtgctaggctctactctatggcccagagttagagttaagttcctgcactaatgaagcttatatccagtgggagaaatggaaataagtaagtacataatgtaattttgtgtagttatatatcccataagaaagtggaattggataaggaggcaaagagatatatgggaaaagcatttatgacagaggaaagagcaagtacaaagtcccttaaggctgggtgttttcaaggagtattgggaaaacaagtgtgaattggtatgagtaggggagaccgaaagtagaaagaggtgaggttttagaggtagccagtggtcaaataaagtagattcttataggtcatggcaagtacttaggattccgaaaatatccactaggaaagtttgagaagagagtgggtctgacttatatatatttttttttctaaaaacccctcattctgactactgtccagagaatggactataagggggcaagagttgcagcagagaaagaagttagccattcattgcagtcatgggggtggttttgaacagctaaggggcaatgaaagtattgagaagtggtcagagtctgggtctgttccaaaatcaacaagataagctgacagtttgaatatagggcatggaagagagaaatcaaggtatggatatggatcggatagggatggctttgatatgtaagggaagagtccttggtcccgtgttcttgtttttcttcattgattcactttttggctgttttgttcactgctgtattcctagaacttagaatggtgcctggtacatagatgatactccataaattttgaatgaattaatactaagagtggattcagtggagtgatagatgaaaatacttgattgatatagatagtatgagggaatgattgttgaggaagttgagatagagataatgattgaaatgggttaccataaaaggcaggcagaaaaattgagaaagggttggaggaatgtcaggtcaagggatgatttttttttcaaaatgatcgatgatattgcatcacttttatgctgcaaggaatgagccagtatagagggacaaactgacaagtgtgggagagatgagacaataaccaaataatacatttgaccaggagacaggaaatgggatccaggacacatgtgggggtgcttgcattagataggagcagacactcctggtaacagggaaaaggttaaagtatatggctgacattctggtaggttggtatagttgatattaggaaggagagcgcatggtcttttgattgcttggtaaaataagaagcaaagctatttgcagagattctgggaaaagagttatttcttctcccagagagaaaagaaagtaaaatattatctcttgagagtgggagagtgaattggtttggcaagtgcaaaaggatcgtgggacattgaagtatgttgaagaaaatttaaagagaggccagtcaggcattatgcagatttttccagatatattaaggtgcttatttgtagatggagagttggatttgaccaaggtttatgtttttccaggcaggtacagtacagtatgagagatacaagtgtattcagggtgtataccagacaatgattatactgattttaattatggactatgtatgttatccaagcagggtaagaaaggaaatgagaacgtgaagatgatgatgagcaattctaagattgtaagatcagtagattagaaatccgtggagtggggtggaatgggtggatgtgggtagaagaattgacagtatgaaggtgctagatgaaaaatgttggaaatatgtggtcagagagtgattcaagatcatggacttgtaatgacaagtcttaggatatggccatggaagggacaaatggattaggatagagctgaggctcattggaggaaaagaggtcaaataatagacctgtagtttacagtgaccaaaatttactatatgtcaagcttaaggctaatgctacatatgaattagattatttaattcttatgacaacaatggattaattaatccattatttggattagaatattgagtcaaataacctgcccaatttcaaatttctatgtggtatatccagaattgaaactaagatgtttttgtcttgaaaacctttatgaatgacagtgctttgaggctaggtggaattagatgaccttaaatgaaactctggtgacaagttgtgacaaatggcagagttgactttgtagtatctgggtaacaacatgtggaatgactttgttcaggtaaagttctggcagacagtcctcatgtcatccaaacagggacatttgtaagcataatgtcagtatctggtggtttctaggtactgaaataaagaagttttaggaattccaatagaataattggtcgtattggtaccttgtacatagcaggtgctcaaatgtgataaaatgaatttgtctttggacaagacttatcagaagacttatcccagtagcaggtgtttaactaggcattttacgtttgttatcttatataatattgacagcctttacaagatggatgttatccccattttttattgaagaagtaggtcattaaagcctaacacaactagtatttggtagtgcccagtaacctttcagtctggcaggttccaaagcccatcctacaccttatccttcttaaccaattttcctcatttaggaatgtgacttagttacaataccattcatttattcagtatttattaagtactcattatttgtcagatattcttctatgcattgggcatatatctttgaatttaaaaaaaaccaaaatcctcatccccattgagcttttctatctgagaaacaagcaatttttcttccttttagacacaaaggaagaaaaatagggcagacaactgtataggatgtatgaggaatgtgtggaaggcttgaaattttagatagggtggccagggaagccctcaatgaaaagatgatattttaataacactatgaaggaagtgacggaacaaattatatgaaaattggatggaagaacatcccaggtagaggggatagcaggtgcaaaggccctggtgcaggagcatacctgacatatttcatgagcagcgaaggaggccacagtggctgaagtggagtgtgtgagacgggagggtagtaggggatgagactagccagctatttggagatcaggtcatgtaggaccttgtagatcatatatttatttatttatttattaattgacagataaaaattgcatgcatttaccatgtacaacatgatgtttcaaggtatatacacattgtggaatgactaaatccagctaattagcatatgcattctctcatgtagttataatttttatggtgacacatacaaggggccaataggtatatgataaaattctcaatatcactaatcttaaaggaaatgtaaatcacctcacacctgttagactgggcattatcaaaaagaccaatcatgttagagaggatgtggagaaaagggaccttcacacactgttggtgggaatgcaaattagcacagccattatggaaaacaatgtggaggtctctcaaaaaaaattaaaaatagggcctagcgcggtggcttacgcctgtaatcccagcactttgggaggccgagatgggcggatcacaaggtcaggagatcgagacaatcctggctaacacggtgaaaccccgtctctactacaaatacaaaaaattagctgggcgtggtggccggtgcctgtagtcccagctactcgggaggctgaggcaggagaatggtgtgaacccaggaggcagagcttgcagtgagccgagatcacgccactgcactccagcctgggcgacagagcgagactctgtctcaaaaaaaaaaaaaaaaaaaaaagaaaaaaaattaaaaatagagttacatgattcagcaatctcactactggttatatatccaaaggatattaaattagtatgttgaagagatatatgcacttccatgttaatgcagcgttattcacaataaccaagatatgaaatcaacttaaatgtccattaatgcattaatggataaagaaaatgtggtatacatacacaatggaatatgattcagccttcaaaaacagtgaaatcttgtcatttgtgacaacatggatgaacctatagtacattatgttaagtgaaataaggcatacagagaaagacagatacctcatgatgccacttacatgtggattaatctaaaaaaggtgatttcacagaagcagagagtagaatggtggttaccaggggctggaaggtatggtctggggtgggtagatgttggcccaaggatacaaaatttcagttatataggaggaataagtccaagagatttcttgtacaacatggtgactagagttaataatataatatattctcaaaaaatgctaagagactgaggcttttgaaatgggaagaaatgggaggattatgagcagggggaagaaattatctgccttagcactttaaaagttccctctgcccactttgtagggaacagactctaggggagcaaggacagaggcagcaaaaccagttaagaagcttttacaatgatcttgacaagagatgacaagctagagtggtagcaacagaggtaatgatcaatggctttaatttggatatatttccttttgaatggaatgccaatgagacttgttaatagatcagatgtgtggtttgaacgttaaaggggagtcaagaatgacattagagttttaatcagagcaaatggaagtgcagaggagtcactattacttgagatgggaaatactgcacaggaccaggtctatatatgtgtgtgggggtggatatctgaacttcatatctgaaaatgttatgtttaagatgcctctcagacatttaggtacagagttttgtgagaggtatcttaaacctaacctgggtttaagttttacttatgagttacgatatgagtttaagatatgtgttatctcctggaacccatatctagatacatatatggattcgaggtaatatctggaatgaagatattaatttgcaagtcatcagtttataaatgatattttcgtctatttgtttgttccttgtaccttcctttagctctttagtagggtgaattggttggtaatcatttgctaatttggccatgcaattacatattataatggcctgagcacgtgtcatgattatgtgttcatgtatcatggataatctcttctaacaccatgattatctgagtttgcacaagagttgtctcctcctgtttcatagccaatctgctcctgccaaaggcatctgcatttgtgccatggttgactgtaaactcacaggacattttttttttatgtactgtacttatataagcatacactatggttgtctacttttgcaacatagcctggcttcttgattaaaatcagcaataggttttaccttctgcttgtacatcatggttgtctgaatattcgtatgatgttccttcactgtaattttcattttattcaccatggatatgtgcgttatatttgtgtgttcgtacactacaaatagctatttattcactgtcatcatcattacccaaaggatatcaattcttcactatggtcacttgcaactgtatcttacctttctgctacagtgaaaaatttttgaccatgtctgcctactcatggaccatgaccttttgtgttcctgcaccatggtaatctaattccatagcacttcagtctgctcctaaaccatttcacttaattcctatagtatggttgctatgatacatatattctgtgtgcatttatcatggttaagaattgatgtaccaaatgcttcttcacatgtatcatgtttgtctatgcatatactgtatttgcctccagccacatggatgtgtgatcatttttgaaggctctttgtttcactgtcacagacattttatttagttatgatttcatgtaatgctgttgtcttttttatgtatcatagtatatgtcttagttttctctttccaaatcatgggcatttaattctatgtaattgccatctattcttaatatgatagtttgctgcttatctaccatgataatttgaacataacccatagtgatatagtagaatagcatagctgaacacacactatggatctctttgtttacacagcatggccatcttctcctacatccaggattgttactcatggactcatgttttctaagcatgcatcatggctatgtcttatgttccatggattatttctatgatttgaacttcatatcctagcccaagtgtctctgttcctgtagagtagttgtcaattcatgtatcgtgattatctgaacattaattcttgtcatatgattacacaacattaaggtctgctaaagcactgtgaatgtttgagcgtatatcatggttactgcccttaccatggaagttacttatgcttggagttgtctgatcatgcactatcttttcttactcatatactatggttttctgaaccgtaccattcctgtatactcctgtaaaatgtccatcaactcttttattgttcatgaagcatggatgtcacagctcttatattaggttgaccataagaaattgctttctttgataaaaccaaaattgtgaaatattggcaatttcatatggtgcaatctaatactatgattatctctgtctctaatgttgacacttcatcatgtcagaagtctgtcttctccattgttgtagtttttcaaatgcctataccagattcatgaagacagcttaatatagatccagtggctgcttttttgaggcgtgtggggtgaatttaaaaggccttttgttcttaatctcaccaaccagaatagctccttaatgtgtatctgttttacatattggtctcttgtataagctttcttggaaaaaaaaccagttatatatccctccattttctctgaaaattaattcactgatatgactgaaaaagggtatgttgttgggtcagagttaggtctccttcaagttctcagtgtctcataatcaaagaagccacacaaattagaggtagcaagtaaccatcactttattggttgctttcttaaccccatgtcttgggtaaatctccactgatccagggttcataaaacagccttccttatagggaactccatatcactagttctatcaccagtataatttgctgacctcttagagatttcagtgtcaggaagtaggcttggatttctctttttgttgtgtcccctatctaaaggaacaagtttgctttcaaatatctctttatggggaaatactgcattcttattcaagagccatgatgtctcattattcagtattttctcaacctaatttagaggaaacagtctatccacttcaggccatttaatcttttggaaaattgtttaactctatgaagctgagaatcaatcccaaaaatgctataaaaagactccaggtcttaatatactaggatagtaggattctctacgatattacacagttaaccaaggcaaaggactttgtaacactaaagatcaaacagggaattggagggaaataaaatgaagacatgagagaatatttttaagatcttagattataagaggtaacccaagctgagggaagttctgtgattcacctaatcacatagggtgaagccaaggaaagagatgttgcagtaacctcagactcctgattactgacttagggctgtttgtgctacactgtgcatcctttcttggatgggctctggtatatttaggagaagggtatattgggggcgattttggtggcattgacaagctgggaaaaggggactgttgaattaagcactgagtaactagacactagagaagttaaatggctctaatagagtttaataacatctctttctctcttttttacctctttctcctctctccctttgttttctactctctacctcttatcccttatctaaactgtgaatctcacaggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggtaagaacccctaactcttaggatgaaagaagactgtgataaatgtttgcctcagaccaaaacttctgatgttttcccccagatgaacccaagtactctggtctctgatacttatacattacattatatttagaaaaaagtcataggctcagactctcaaagtagaaagagatctcaaagtttctttttcttagacaacaccctggcccaggcttgaatcacctctgtaatatcttaaaaatagttcttttgccctcaattttatctctcctctcttagatcttcaaccttttcctttttattggctgtgtggctccatagcatttaaacatgataatgtttaggaatcactcatcttaaatttaaaaatcttccctccagatactgccttaattatttgctccccttcatagccatatttcttgaaggagtggtatgcttcattgcatctatttacctctcaccctttcattcacttgctgccatctgacttccaaccccagactctaaggcaacttctgcagccaagatggccaatgttggttctgttgctgaaatgaacacttctctgttcttacgttccaatattgttgacttctccatccttgacttcattttattatgaaataaaaatacatgtagaaacatgcataaaatataaatatatagtttaataataattctttttggcttcagagacactataattctctggtgttttgattgggttctctagaaacagagtatgaaacaaggattcttgagcaaatgatttattgagaggtcactttcaacagaaacctgtaaggaagtaagggaaggaagatagggaaagagaagaagtaaagcaaaggtgtagcctcaatttgacctcatgaggagaagtggggcataaatggcactaaaagatttgtcctactttgaggcaagggacccaagcttgtgtactctcacctcaattagtctttgcctgtggatcccctggagaaaggcatagtcttccagatattttaggtgaggcgactccctgcaacagatagtaattttccaaagtagctgcaggatgatttcactggcccagtaaagggatccgagaatagtattataccaataataaatactacatctggttttctttatacttttatgactatgctttctgcaatattttccacaatactacacaggtacatcaaagacctttgtgatataaagatcctttttagtcttcttttgttcacccctcaggtgtttgtgtttttccttgttttgttctaggcacacttcttaccctacagatcccctgagtgatgtaatccatttctatgatgtagttaccttatatatgtaaatgccaatgactcccatctcaatcttcattctagacttctcttgaatgtcagacttctatatccaactgtctactgaacatgcccacttggctattccacacacttcttaaactaagcatgtccaatgtatttaattagcttcatctccctcccccatcctaaagaacaaacataacaaaacaaacaacaaacagacaaaaatattcctcttccatttttttcctgtttcagtcagtggtaccactgtgtacccagttgctcaagtcagaaacttggaatcatttttgccagttttctaccctttactctccagattgaatcaatcaccaagatttgtcatttctacctcccacatctcttggattcatctacttttttccaacttttctgctagcaccctagtttaatctgatgttgtctctcacttggaccactgtgcaaaccttgtcttacttcctaaaatcttgtttccatccaaactaacctccactctgtaactatttttttctgtaatgcatgtttgaccatacctaccctatttagagccctttcatggttttctgttgtccctacaataaggtacaaactctttaacatgattttataaaacccattaggacccagcttctacccaccttgctagccttatttcttagtctttctgccaccaaactgtgttcagcaatgttgaactccttttagactttaaaatcccttctaatccaaggaatatcattactagaaatgacctcttagccctgcaatatttcaatattacccaaggtattttattccttggtagtgactttttttttttggttttacatttggctattgtcctatattcttggaagcatgcatcttgaagtaggaagtattcctaattatttttgcagtgttgattatcttaatgtactctgagtcttttcatcttatatcagcatttttacagtaatctctggggctgaggctgcagaactgggcttgtatatccttagaatcttggtatataagactctttttgttctttcttccaaaatggaaaataaaaccagttctgttttgttaactcctcatgtatttcatttcactgggccatgatagattctaaataagatgaaggttctaaataaattaaccttaccgcttcaagtgttaaagccttttacattttaactctgataatatagttttctaaaaatgtattgcatattttcttataatcctaaacaaggatttttttaaacagaatagtcccatttctttgtgacttttggtcatcataaagaaaattcacggttgcatgccatggcacatgcctgtagtcccagctacttgggtggctgatacagaaggatctcttgagcccaggagttaaaggccagccatggccacacagtgagactctatctctaaaacaaacaaacagacaaaaaaaaaaaccacaaaaaattcttaagcacatgttcattatattcattcgaattttttttttttttttttttttgagatggagtctcactcttcacccaggctgtagtgcaatggtgcgatctcagctcactgcaacttccgtgtcctgggttcaagccattctcctgcctcagcctccggagtagctgggattacaggcacatgccaccacgcccagctaatttttgtatttttagtagagatggggtttcaccatgttggtcaggctggtttcgaacccctgaccttgtgatccgcccgcctcagcctcccagtatgagccactgtgcccagccagtgttagttcttatgtcccgtgtcctctttacaatggtttgttagcatcctgttgatgcttagaaaaccagatagcctagtttttagtaattatgtcaaggagtaggccaagaaatcctacctgaaaaagcagagtgaagtgcttggttttagtaaagaggcaatacaatcactgcatgttttctttctttctttctttctttttttttttttttttaaagacgtggtcttactctgctacccaggctggaatgcagtgatgtgatcatagctcattgtaacttcaaactttcaaactcctgggctcacatgatcacatgatcctcctgcctgagcctcctgagtagctgggactacaggtataagccaccacacgtggctgatttttaaaattattttttagagatagggtctcactgtcttgcccaggctgatctcaaactcctgacctcaaaagatcttcccacattgacctcccaaagtgttggtattacaggtgtgggccaccacacctggtttctgtttcttgaattagaaacattttttttttttaatttatttttttttttaatttttttttttaattttttttttttaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaattagaaacatttttttctttactttcctccaagcccagtgcaattaatacttttgaggcatgatactactaaaagcatggcccaaatattaaggttgtattcttctgcatgtcttttgggtaaataatgaaattaaggcagaaataaagaaatttcttgaaagtaatgagaacaaagatacaaataccagaatctctgggacatggctaaagagtgttaagagggaagtttgtagcactaaatgcccaagtcaaaaagttacacagatctcaaattaacaacctaatgtcacacctaggggaactagagaaccaagaggaaaccaaccccaaagctagcaaaagacaagaaataacaaaaatcagagctgaactgaaggaaattgagatgcaaaaaaacatacaaaagattaagtccaggagtgtgttctttgaaagaatgaataagatggatagaccactagttattctaatacagaaaaaaagagaagatccaaataaacacaatcagaaataacaaagaacatgttactgctgaccccagagaaatacagaaaaccctcagagactactatgaacatctctatgcatacaaactagaaaacctagaagaaatggataaattccttgaaacttgcgacttcctaagactgaaccaggaagaaattgaatccctgaacagaccaataacaagttccaaaattgaatcagtaaaaaaaagcctaccaatccgaaaaagtctaggaacaaattaattcacagccaaattctaccagatatataaagaagaactggtaccattcctactgcaactattccaaataactgaggaggaaggactcctccctaactcattctgtgagaaccagcatcatcctgataccaaaacctggtacacaacaaaaaagaaaacttgtggcctatatccttgaggaacgtagatgcaaaaatcctcaataaaatgtagcaaaccaaatccagtagcatatcaaaaattgaatccaccatgatcaagtagactttatgcctggaatgcaaggttggttcagcatatgcaaattaataaatgtgattcaccacataagtagaactaaaaacaaaaacacacataattgtctcagtagatgcataaaagccttttgataaaaatcaacattatttcattaaaatgaaggactacaggtataagccaccacccaaactaggcattgaaggaacatacttcaaaataataaggactatctgtgaaaaaacccatagccaatagcatactgaatgggcaaaagctggaagcattctccttgaaaggcagaacaagacatggatgccctctctcactactcctattaaacatggtactgaagtcctagccagagcaatcaggcaagagaaagatataaaaggcataccaatcagaagatagggagtctaactatctctgtttgcagacaatatgattctatacccagaaaagtctctgcccaaaagttccttgatctgattttaaaacttcagcaaagtttcaggatacaaaattaatgtacaaaaatcagtagcatcatacaccaacaacatccaagctgagagccaaatcaaaaacgcaatcccattcacgatagccataaaagagtaaaatacctgtgaatacagctaaccagggtggtgaaagagctctacaataagcattacaacacactgctcaaagaaatcagagatgacacaaacaaatgaaaaaaattccatgcacatggataggaagaatcaatattgttaaaatggccatacttccaaaagcaatttacagattcaatgctattcttatcaaactaccaatgacattctttactgaactagaaaaaaactattttaaaatgtatatggaaccccaaaagagcccaaatagccaaggtaatcctaagcaaaaagaacaaagctagagacatcacactacctgacttcaaactatactatggggctgtagtaaccaaaacagcatggtaccggtacagaaatagacacctagaccaagggaaccgaatagagagcccagaaataatgccacagatctacaaacatctgatctttcacagcattgacaaaaacaagcaatggggacagaaatccctattcaataaatggtgctgggaaggtggattaaaaacttacatgtcaaacctaaaactacaaaaaccctggaagataatctagaaaatatcattctagacataggacctggcaaagatttcatgatgaagacatgaaaagcaattgcaacaaaaccaaaaattgacaaatgagacctaataaaatgaaagagcttctgcacagcaaaagaaactatcaagggagtaaacagtctacagaatggaagaaaatatttgtaaggtgtgcatccaacaagggtctaatatccagcatctataaggaacctaaacaaattcacaagcaaaaaacaacccaattaaaaaataggcaacagacatgaacagacactcctcaaaagaagacatttttttgtggcaaacaagcatatgaaaaaatgctgaacatcactgatcattagagaaatgcaaatcaaaaccacaatgagataccatctcatatcagtccgaatggctattattaaaaagtcaaattataacagctgctggtcaggttgcagagaacagaatacggagctcagaaataatgctgcacacctacaactatctcatacactgctggtgggaatgtaaattagttcagccattgtggaaagtagttcggtgatttctcaaagaacttaaaatggaattactatttgacccaggcatcccattattggatatatatccaaaggaatatacctcattctatcataaagacacatgtatgcatatgttcattgcagcactcttcataataggaaagacatggaatcaacctaaatgctcattaaagtggattagataaaataaatgtggtacatatacaccatggaatactatgcagtcataaaaaagaacgagatcatgtcatttgcagcaacatggatgcagctggaggctattatcctgagcaaactaacacaggaacaataaaccaaatactatgtgttctcacttataagtgggagctgaacattgagtacacatggacacaaagaagggaacaataaacaccagggcctagttgagggtagagtgtggaaggagggtgagtataggaaaattaccttttgggtactatgcttattacctgggtgacgaaatatctgtacaccaaccctcatgacatataatttacctacataacaaacctgcacatgtatcccctaacctaaaataaagctgtaaagaaaaaaattatgacaaaattagacttggttaatcataaaaagcacaaatattagagttgtatttgccataaataaaggatccaatataattttaaagtatagagtttttgctgatagttgtggtacttaagagctgctgctgctttttgattatttccgtactttcttaattatgtttttgtgtattgaaaaaaatccattactgcattattttatccaactttaatgatttattcaattaaaccacctacattggccgccacagccattttaacaatcaacagtggtttatcgaccagtactttgtataactcatgtgcttgatgtaatagttctcaacattcagtatttgtaagcaagaaagcaggcttctgcatttgaagattatgatttggtagctctgggaatagtgcctaaaatgccccagatgattctggtgtaaggaatctttggggacacagttcctgtttttaagaaactaacagtatagtttgggatttgggattctggaactttagaacagcacccatggaaaaacctgtagagagcatctaatctgattttttaatctgtacctgaagaaactgaagcccagaaaggaaaattgactttcttacaatgagttcataagagacccaggtctagagcaccagtttctgattcccagtcctgcatttttgataagaagctacagagagtaatttcaacttcatataataaatgaatttcctatactcctggttcctggtcaagtattttgaccattagcaaatggaattatgtacgtgaacaatgtcaagttgaaccattttgaaactgacattttgctaggtcagaacgattgaatatcagcaattttcataatgggtcaacacgtaagtgcctaagcagcaaatgccaggtctgactgcaatttgttgaatttgtcaggatcccagagaatacagatgggacatttcaattatttgaggaggatatatttgcagagactaatcataaagttatgatctaagtggagggaaaccgcaaggaatagagtaagaacctaaggtgaacagcacacatatcatgtaaatcaagctttcttcagaggtgcagatttttggtggaggaaacagccagcctgagaagatttcacagggagagagccagggagttacatgcccagtcttttcgtcttcctctgatcttcagccaaggtggccaaactcaagttgaagcaataggccaatggcgcccataatgtagtgcataaaaattagccttctagaaaggagaacggggtggagaatagtgaaaaggcaaacgaaatatgctgcacacaaggccgcatatttccacactactaatagagtagggactatgatttgggaggaatatgacactatattaacacattttctgcatcaacatcatatggtggtggccatggtgacaactgatgcagtgaactgaagaggagactgctggggagttgcttgtctccttgtcatatctacagcctgacttggttctactatctaaaggtgtcagtgcttgtaagcatctgtattcatcttgaaaatgattttctcagttctcttaatctcagaataaactgtcacctgtggccacacatgtacttacttttacttggaatataagtatgaaaagtccaaacccttccatttacatgtaatttctattaaagaatcaatgcatcaatactcttagcatttgaccatcaaatcttaaaatttcagaaccagacttgggacctgagaggctgtcagttcctaggctcctatcctgggaaagaatccctcctgctttatggttgatgattcacctaccagtttgaatctctgcagtgataagctgcattagtaccacagggcatagctccaggggttagaaagtgcttcctatattgagctgaagtccaccttcttcaaacacctcctagttatagggccctgtaacatttgcaacatttgcttctttttccacatagtggctttcagatatactccatgctttcttgtctgcaggctaactctcattcctttcaaatattctcttggcataatatggttttccagacattgcttcaaactggacactctcccttgttatctaattaagccatttttttgagattcgattccttagtcttacttattccattatgttagtttaaactttatattcatagagtcctatataccaagctctattctaagttattaatatatgttgattaatataatccttataacagacctgatagctaagtgatgttattattcctttgcagataaaatatggagacagagagaggtcaggtaacttgccaaagctcacacagctagaaaatagaagagttaggattgaaacccagaaagtttggttccagagtccatgctattaatcattatgatatattgcttttcctgagtttggttacttttaagtaagaatgaggcacatgtcaatttcttttacatacctgaatatttacttacatatagtaacctctcaaccactgaattcttaatatctcagccacatagctgggtagaccatgttcagatgtggcaagtgcatttttcttataggacctggagaaataagaaatgtaattttatcctaccattttcccttttgaggtggaagtgcagaatttgtaacacagaacagggatggacatgtgaggccacaatcaatgatactttgtaggtgatgttgtggcttcctgttgcgttatgtcaggaggcaaggttgtctcagtatggctgatactgaattttatcacttgcttagggtgatgactgtcgggactcgccattgtaaggatatcaaccatcaggattaattcaaagtctttgagctgatggccagctcattgctttgatcatggctgtgggtgtgggggtaaagaacaaataatagtaggggagataatatttttagtactttagttttcttttcttttgtgtcaaaaaatgtctttccacataaacagtgttataaatggttctcaggttggcctattaatacctgcttaaccagaaacgttgccaaaatagtgctcatgcattggcactatggttacagtcattcagattaaccatgagaaacagtattgcttactcttgtctagaaaactagctaccctttatggcattgtttcaaaggaagaatgtacccctgcttctttgcaaactttggttcatgacacattttaaattgcgatatgtctgcttatggtcacatggaatcatatgtctactagcttattttatcattcacaacatatactaattaaatatttctcttttttgtgaagcagtggcttttagttactaagaaggcatgaaggacttggtctttattttaccaagtgggtaggtgtgtctcaagtcagtacctctgtagttttattaccagtccatataagctatttcagaaaagaacagctgtctttttcagatggatttggcgtattctagccaaaatcaggttagttcttcttctttttttttttcttcaagcagcttctgtaaagagaaagtgtgctattgaattctaggtgtttctcatttcctccctagtatataactggcatccttagtgctgaatctttagttgaacatttccacttataggaaagactggacttgaaaaatgaaaacatgaggaatatttggaaatggtgagtaatctgatttgcctgtgattggtggtcagaaagagaagtagtagaatttgcaactgtaaaagtatatcaggaacagattgcagaaggccatgattgtcaggcttaggcattggaattttatttggttagctatgaagagttatgaaaggtttgtgagcgatgcagagacataatatgctcagtaattccgaatttttattatttaaaaaaatctgctctctcccaggaaatatgtggtttaggaaaaatgccatccttttaatgaagtaagtatctttcctctttgggatgttgtatgaactgcgtcagcaactccacatttgtgcctctcctgctttcccttaacataaacacaccaggatcctcaatgaaggatgctggcagtgacagcatgagtttgacagcttcattgaggatgctctagatggtcagtgatcttgactttctcccattgcctaaaagataatgtattgtaaaggtttttcattgcattttcaggagtttggggggaagttaatgaacaaccttcatttataaaacaattttgtatttattatcttatttacctatttatttcaaaagttttctaatgtaggttattgttatccccattttacatatatggaaatacaggcatacctcatttgactgtgcttcactttattgtgctttgtggatagcatgttttttacaaattgaatgtttgtggcaaccctgtgttgagtgagtctattggtgccatttttccaacagcatgtgctcactttatgtctctgtgccgcattttggtcattcttgcaaattttcaaagtcttgattattatatctgttatggtgatctgtgattggtgatctttgatgttattattttaattgttttggggcaccatgaattccactcatgtaagacagtggacttaatcggtaaatattgtgtttgctctgactgattattccactgaagggccattcccctgtctctctccctctccttaggccttccttctccctgagatacagtaatgttgaaaataggccaattagtagccctatatagcctctaagtgttaagtgaaataaaaatttacatggctctcactttaaatcaaaagctagaaatgattaagcttagtaaggaaggcatgacaaaagttgagatactctaaaagctaggcctcttgtggcaagcagttagccaagttgtcaatgcgaatgaaaggtttttgaaggaaattaaaaatgctactccagtgagcacataaatgataagaaagtgaaacagccttattgcaaatatggagaaagttttagtggatagaagatcaagccagacacaacattctcttcaagcaaagtctaattcaaagcaatgctataactcccttcagttctgtgaagactgggagagataaagaagctgcagaaaaagtttgaagctagtggaggttggttcatgaggtttaaggaaagaagccatctccataacataaaagtgcaaggtgagacacaagtgctgatggaggagctgcagcaagttctccagaagatctagctatgataattgataaaggtggctacatgaacaacagattttggtagaagaaacatccttctattggaagaagatgtctttcaggactttaatagctagagagaagaagtaaatgcctgactttgaagcttcaaagcagtggctgactcttttgtcaggggcaaatgcagctggtaactttaagctgaagcccattgttcatttactattgggaaaatcctaggacccttaagaattatgctaaatccactctctctatgctctgtaaatgaaataacaaagcttgaatgacagcacatctgtttatagcacggtttaccgaatattttaagcacacggttgcagtctacttcccaggaaaaagtactccttttgaaatattatttttcattgacaatgcacctggtcacccaagagctttgatggagatgtgcaagatgaatgttgttttcatccttacaatacaacatccattcttcagcccattgatcaagaagaaattttgactttcaagttttattatttaagagatacatttcataaggttatagcttccatagatagtgattcctctgatggatccaagaaaagcccattgaaaaccttctggaaaggattcacctttctggatatcagtaagagcattcatgattcagaggagcaggtcaaaatataaacattaacaggagtgtggaagaagttggttccaatcctcatgggtgactttgaggggttcgagacttcagtggaggaagtaactgcagatgtggtggaaatagcaagaaaactataattagaaataaagccctttcaaaaaaccagctcctggattcattaattttttgaagggttttttgtgtctctatttccttcagttctgctctgattttagttatttcttgccttctgctagctgttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtaattgagcggttttgagtgagattcttaatcctgagttctagtttgattgcaccgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctttgcacgtgagatgggtttcctgaatacagcacactcatgggtcttgactctttatccaatttgccagtctgtgtcttttaattggagcacttagtccatttacatttaaagttaatattgttatgtgtgaatttgatcctgtcattatgatgttagctggttattttgctcgttagttgatgcagtttcttcctagtctcgatggtgtttacattttggcatgattttgcagcggctggtaccggttgttcctctccatgtttagcgcttccttcaggagctcttttagagcccaaagttgtgactgaattgctgcaatctcgtgaaaaaacttgaagggatgagttgcttcttacagacgagcaatgagagtgatttcttgataaggaatctactcctagtaaagatgctgtgaatattgttgaaatgacaacaaaggatttagaatattacataaacttagttgataaagcagtgccagggtttaagaggattggctccaattttgaaagaagttctactgtgggtaaaatgcgaccaaacagcatcacatgctgaagataaatcttttgtgaaaagaagagtcaattgatgaggcaaacttcattgttgtcttattttaagaaattgccacagctgccccaacctttagcaaccactgccctgactggtcagcagccatccacactgaggcaaaaccttccaccagcaagaagattatgacttgttgaagcgtcagatgattcttagcatttttttagcaataaagtatttttaattaaggtatgtaaattgatttttagacataatgctattgaacacttaatagagtgctgtacagtataaacataacttttacatgcacgggaaaccaaaatatttgtgactcacttaattgtgatatttgctttattgcagtggcctggaaccaaactcacaatatcccagaggtatgcctgtaggtctcacagtcagttagtggcagagacagaactaaattctagtcatttgattctggtcctgtgaatttaccactgatccatctttagggctaggaaaatgactaaacttggcataaccttcagatagtgtattagtaacgtcattttcatttttcaatgatgaattattattattatcatattttatctaaccagtagtggcaaatatgaggtgcaatggacatgttttagtgttgctctcattaagttgataaacacatagcatcaagcaattcatttctctctttggtgttggtgtcttaggtgtctcatgtgtaaaatgaagggagagaattatacaatatctaagcttctccataattctgacatgccatgattccttttttccccaaactacctttgaattcaaactataggatcacgttgcagtttagttactgaataagaaagagttctacttaggtcgcagattaaatctgcttccccacacaataatttagtgcacattaggagaaaaaaaatcagtaataaagaataaaaccatagaacaatatattgaaaataatttgggggtgatatttagcattgatttttatttatttatttatttattttagacagggtcttgctctgttgcccatgcagtagcatgatctcagctcactgcaacctccgcttcccaggctcaagtaatcctccaacctcagcctccccagtaaatgggactacaggtgtgccaccatgcctagctaatttttgtgtttttgtagaggcaggatttcgccatattgtccagactggtcacaaactagcattgctttttgacttaaaagttttcaactttttgatgaagaatgatgctaagatatcaacagtcaccaggaggaaatggaaatgcattctcatggaagctagtatttcagtaagaaagcaagcacagtgtattggccttctattcaggattttaaagaattgtttaatttttcatttttgtgggtacatcataggtatatatatttatggggtgcgtgagatgttttgatacaggcatgcaatatgaaataatcacatcatggagaatgtggtatccatcccctcaaacatttatcctttgtgttaaaaacaatccaattagttattttaaaatgtacaattaaattattactactgatgtcaccctttgtgctatcaaatactaggtttcattctttttattattttatacacattaaccatccccactttccctcaaccactccactatccttcccaacctctagtaacaatgcttctactctctatctccatgagttcaattgttttaatttttagctcccacaaataaatgacagcatgcaatttttgtctttttgtgcctggcttatttcacttagcataatgatctccagtttcatccatgttttgcaaatgacaggatctcattatttttatgactgaatagtactccagtgtgtacgtgtatcatattttctttatccaatcatctactatggatatttaggttgcttccaaatcttaccgattgtgaacagtcctgtgacaaacatgggtgtgcggatatctctttgatatactgatttcctttctttggggtatatacccagcagtgggattgctggatcatatggtagctctatttttaatattttgaggaaccaccaaactcttctccatagtggttgtactaatttacattcccaccaacagtgtacgagggttccctttcctctacattctcatcagcatttgttatttcctgtcttttggatgtaagccatttcatctggggtgagatgatatgttattgtagttgtgatttgcatttctctgatgatcagtgatattaagcaccttttcatatgcctgtttgtcatttgtatgtcttcttttgagaaatgtctattcaaatattctgcccatttttaattggattattatactttttcctacagagttgtttgagctctttatctattctggttattaattctttgtcagatggatagtttgcaaatattttctcccattctgtaggttgtcccttcactttgttgattgcttcctttgctgtgaagaagctttgtaatttgatgtgatcccatttgtccatttttgctttggttgcctgtgcttgtagggtattgctcaagaaatttttgcccagactgatgtcctggagatgttccccaaagttttcttgtagtagtcttatagtgtgaagtcttggatttcagtcttttaatccattttgatgtgatttttgtatattgcaagagataggggtctagtttcagtcttctgcatatggatatccagttttcccagcaccgtttattgaaaagactgtctttttttccagtgtatgttcttgatattcagcaaatagttttccctttccccataggatgagggtagaagtagactatgtacaatttaaggatctgtctaaccctgtttttctgtgaacttaaatttctctgggctagaagtgaggtaagttctcagtaacatttcccttctttattttgatgcctgtttaatcatgcaacacaatttgatgaaccaactgtatgccgggaaatgttctcagtgacattctgtccagaatttctacttgtgtctctttactgctgggttggggccaggatatatgcctggcaaagctcataccaatgctagagtaagagttcgagtattaaccacactgtctgcctcctacacaagcaatcattgtgacaaatatgtagtgattgctattttggataagatataggtctatgtaattggcccagtctattaattgaaatcttgaattacgatatctagtcatgtattttttttcctattaagaactattattttttttcttttccttgcattgcctcaggctgtctcctaagcatgccccagatattcctgatgacagcactgacaacatcactatcttcaccagaatcttggatcgtcttctggacggctatgacaaccggctgcgacctgggcttggaggtcagtccttttaagatctttgaagtccttttcagatcttcttcttggccattgttatctaaaaacagttataaggtgccttcagtagtctattggccaatgagattagtgtaaagctgaatttcttccctatgagcactaaaaattagtcataatccttcatttcagtaggtgatttctctggtctggcttcagaagattctaggtttttgctaggtgcatatggagtaatacacagatgttccatgactcacaatggtttgacgtatgatttttgtctttatgatgggtttatgggacatagcccaatggatttagacttactatatttccaacttatgatgggtttattgggatggggtcttgtaagttgaggagcatctctccctcaaggttagacaatgcccatttctagtaacagaataccaatacctgcctgggtgactggtgtggtccaggaaaagctgagaaacatgcctttgttttcaaaaccctgagcatatatcagcctgacactccaaaaaggaataatctactggctatgtgagatcttagttggccatcagtttagtataatcagcaatatgatcacaataaggtaaatatattataatatatcacgggttattataaattcacaaaatgtaatctaatgctcttttgtaatctgtagtccatattcaaatttttccaattatccccaaaatgtactttatagaaattttcattgatttaggattcaatctaggattatgcattacatttattgttgtgtctgtttagcctacactcagcatttctttgtctttcatgacattgattaaatcttccatatttattttcaaagtaacaccataggagttaattatgtctttatcagcacattgctcaagaagggacttgaagtctgtttgctccattactggtaatgttaatgtagatgtttaccaggttgctgcactctaaaattactattttaaaagtttataattaatacgtaatttgtggagagatgttctgacactattttatgccttttccagcttacacccaatagtcttaacaactatagattatccctgtgagactaataacaattatggtggcaaaatggtgattttctaaagcgattattattctacacttactaaatgacattctattgtaagaaaaaatctctttctctttaattaattagctaatgtcagtatgaatggatttttgctttattcggtggattacagtccattaatatcattcatttcaatagactattttgattaaaatttttgctaataatttcccatattccctaagtggaagcctattccatttggcttctgtttccttttgatatgctctcattttttgagtactttcttattatatggcatgacagtatattccagacttattttgtactttcataatccagccttggaattagtcatttttccaagaataagtggtaccttttttgggaaattacatttagaatcaaatttctggctgctaggtgtcctcattactgctaggatctcattgcttccaggatttttcagtagatagaactgggaaaatagcaaatgcacacacactcacacatatacacacacagatgtattgtatatatgtatatgtatgtgtgtgtgcatgtatggcaataagtttacactgatactactaattgcagtccaacaagtacttttaattgatacatgtacccatttgtttaatcctacaatatacaaaaatattttgaaattactacacccatagtactacaataaacacattaagtaaagttaaatatatatttgcagttttttcattgtgttttgattttggactaaggctatgtaacgcctgcttttatataaataatggattagagtagagcggtattgaaggaggagagaccagtcacaaattaattgcaattttctaggatgaaaataatgactgtgtgaatggagagaatttggtgactgcttagattatggggttagaaaaagaggaggagaaagggataacttctaggttcctggcttgtatcactgggtggtgctattttctaaaatagggaagactggagggagaatggtgcaattgcgttttgttttttttttttttggatttgaggttggaacaattaatatggaaagaagagaaagaaaataaggaccagatttactctcccatcttaaacaaccacaaagaaatgaacaaatatatagtgttttatagaaatcaaacaaaggcagcacaggatattgattcctgaaagaaagaaaacaaacaaggtgagctctgtgattgctgatccttaactgcctggagcaaatttttaggctacagtgcagggaggggagcccagatagcgtctggtggactgtttcagttgagaagaagttgagaaattggggaggccaaggttattaattcataaggcagaggagaagatagagctgcatggagactaaaaagttgtggagagaaagacagagagagagaaagcagaaatctgtagagggtgcttcacaagttttcaagtatgtactccttacctcacaactcaaggatgtactccttacctcacagctcaaggatgaggaaaagaccactggaaacagtgggtaaaacatcagggtttggaataacttgtgttttcaccaaccagagtttccatcactctacttggtggaaacacttttaacacctggtacatggggtagggtacttagaatatggcctcagtggcatggcaaaattatcccaagactaaaggctgctctagtcccacatgacaaaggttaaaatcaagcttcaaagaatttaactatttctaagtaacacattatctcggaacaaaaatcaaaaatatttatagcagtaaaaaaatctgatatctgacaaagtggaattcacgatgattccagtcaaaagtttccagtcaaaaaatttgagaaaattttctggaaaaaagtttccagtcaaaaattaccaagcatgcaaggaaacaagaaactacaacccaaaaaggacagaaacgctaataagcctaaggatatagcaataataattagcaaaaacaagacatggagagaaagaaagactgaaaaatgaaatggaaatcagtgcactgtggtacagcttcatgtagtctaatgtaactgtaatgggattatctgaagggggcagaaaatatacttgaagaaaaactggtcaaaagattctgactttttgggcaaatgacattaatagacatttctcaaaagaatatatataaatggttaagaaacatgtgaaaaactgctcaacatcactaatcatcagggaaatgcaaattaaaaccacagtgagatactacattcctcctgcaagaatggccattattaaaaagtcaatagggccgggcgtggtggctcacgcctataatcccaaaactttgagaggctgaggtgggcggatcacgaggtcaggagttcgagaccagcctggctaatatgatgaagccccgtctctactaaaaatacaaaaattagccaggcgtggtgaggtgtgcctgtagtcccagctacttgggaggctgaggcaggagaattgcttgaatccgggagacggaggttgcagtgacctgagatcacgccactgcattccagcctgggcaacagagtgagactccatctaaaataaaatagaataaaataaaataaagtaaaataaaacaaaataaagtcaggctgggcatggtggctcatgcctgtaatcccagcacttttggaggccgaggcaggtagatcacaaggtcaagagatcgagaccatcctggataacattgtgaaaccccgtctctacgaaaaatacaaaaaaattagcggggggtagtggtgtgtgcctgtagtcccagctagttgggaggctgaggcaggagaatggcttgaatccgggaggcagagatggtagtgagccaagatcacgccactgcactccagcctggcaacagagcaagactcaaaaaaaaaaaaaaaaaaagtcaatagatgttgttatggatatggtgaaagggaaacgtttatacactgctagtgggcatataaattagtacaacctctatggaaaacagtatggagattccttaaagaactaaaagtatagctaccatttgatccagtaatcccactacttggtatctagtaaaaggaaaagaagtcattgtataaaaaagacacatgcacatatatgtttgttgcagcccaattcacaattgcaaagatacggaaccaacctaagtgcccatcaaccaatgagtggaaaaagaaaatgtgatacatacacattgtggaaaactacttggccataaaaaggagtggaataatgtccttgcagtaacttgggtggacggagctggaggccattatactaagtgaaataactaagaaatggaaaaccaaatactatatgttctcacttataagtgagaactaagctatgattacacaaaggcagacagagtgataaaatggactttggagactcagaagtgggagattgagagggagatatgggataaaaaagtacatattgggtacaacgtacactactcaagtgatgggtgcactaaaatctcagaattcaccactgtataattcatccatgtaaccaaaaacacttgtacccaaagggtattgaaataaaaaaattaaacaattctaactttgattaaaattgcaatctccccaaccaagaaagtcaacaactccaaggacaagaagcatgaagaaaattacaccaagagaaaggaaaaaattgcttagaaccaatgataaaaagaaaatctgaaaagcaaatagagtaaaagaagacattatgtgcagatgaaaaactttagaaggatactagactttttgtcacaaggtagtggagcaacagctttaaagtactgagagaagaacaaaagccatcctaggattctttaaccagagaaaataaatttccccccaaaaggcaaaataaacacttttttcaaacacataaacacttaaaaagattcatcaccagcagatctgtactggaagaaatgtgtcagcacaaggaaaatgatgccagatagaaatctggatctatacaaagaagggaagggcagtggaaatggaaactgtgggtaaatgtaaaatagttcctcatttaaaaattctcaccaaatgataagtaaatacttaaagcaaaaataataaccatgtattgtgtagcttgtaatatatgtacaaggaaaatgtatgtcaatgaaatcacaaagaagtggaaatatgccattgaacagttttgtattacacagaaagtgagataatattacctgtaggtaaactgtgataaggatgtgcactatagaacttgaaaatttagctaataaagcaacgaaggatgtaaaaatgtaataagaaaaatattcaatccataggaaggcagaaaaagaggaaaagctaacaaagaatagaagaaacaaacagaaaacaaatagcaaggttgtagatttaaacttaactacacagataatctcattaaatataaatcatctaaacacccatatttaaaggcagaggtggtcagattggatttaaaaagagcaaatttctccctgagagaaatgcactttaaatataaaaccacaagtgggttaaagataaaatgataggaaaagatgcatcatactaacacaaattaaaagaaggttggagtagttattttaatatcagaaaaagtagacatgagagcaaagaatattactaggagtacagaccgagaagtgaaacgagaaagagatggtctataatatagttagagatttcaacaacgcccgaattagataatggaacaagtagacagaaaataagtaaagaaagcagaaacttgacccatgctaacaaccaacttcacctaactgacatttatagaacattccaatcaacaacagcaaaatacacattctcttcaagtgtactgcaacatttatgaaaatagaccatattctgcattataacatttaaaaaaattacaacataggctgggggcagtggctcacgtctgtgatcccagcactttgggaggccaaggtgggcagatcatctgaggtcaggagtttgagaccagcctggccaacatggtgaaaccccgtctctactaaacatacaaaaattatccaggcgtggtggcgtgtcccagctacttgggaggctgaggcaggagaattacttgaacctgggaggtggaggttgcaatgagccgagatcacaccaccgcactccagcctgggcgacagagcaagactccgtcttaaaaaaaaaaaaaaattacaacataatagggtgttctttcccgactttatgtttttgtttgttttgttgaagattgattggctgtatttgagtttatttattaatattgttaaaatgacaatactacccaaagcaatttacagactcaatgtaatctctaccgatataccaaagacgttcttcatagaaataggaaaaaaaaaatccttaaatgtacataggatgacaagagaccccaaatagccaaagcaatttgaaaataaataacaaaactggaggtaacccactcctgatttcaaaatcaactgtgaaactgtagtaatcaaaacagcatcatactggcaaaaaactgacacataaaccagtggaacagaatagaaaacccacatataaatccacatgtttacagccaatttatcttggacgaaagatccaagaacatacaatgataaaaggacagtcgcttcaacaaataatgctgggaaaactggataattatatgcagaagaatgaaactcaacccctatctctcatcatacacaataatcaaatcaaaatgaattaaatactaaaatctaaaacctgaactataaaactgttggaagaaaatattggggaaatgctccaggaagttggtctgggcaaatactatttttgtaagacctcgaaagcacagatgacaaaagcaaaaataaacaaatgggattctatctagctaaaaggcttctgtgctgcaaaggaaacaaccaataaagtgaagagacacccacaaaatgggagaaaatatttgcaagctacctatctgacaagagattaacaactagaatatataaggatctcaaaaaactcagtagcaaaaaataaataatccaatttaaaaatagacaaaagatctgaacagacatttctcagaagaagacatacaaatggccaagaggtacatgaaaaaatgctcaaaatcattaacgatcagggaagtgcacatcgaaactacagttatatatcatctcaactcagttaaaatggctgttacccaaaagttggacaataacagatgctggtgacaatacagtaaaaggagagcccttgggcactgttgagtggaatgtaaatcagtatgggcactatgcagaacagggtggcgattattcagaaaactaaaaacagagctaccatatgatccagcaattgcactattgggtatatatctaaaataaatcaatatatccaacagatagctgtactcccatgtttattacagcactatttacaatagccaaaatatggaatcgacctaagtgcccattaacagatgaatggataaagaaaatgtggtatatgtacatcatggaatattattcagccacggaaaattacaaaatctcttttttctgtttttatttgttgtttgttttttaattttttgtaaggcagggtcttgctctgttgcccgagctggagtgcagtagcatgatcatggctccctgcagccttgatttcctgggctcacgggatcttccttccttagcctcctgaatagctgggactacaggctaatttattttttatatttattttttgtagagacagggtctcactatgttgcccaggctggtcttgaactcctgggctcaaacaatcctcccaccttagcctcccaaagtgctgggattacagttgtgagtcaccatgcccaaccaaaataatgaattcctgtcatttgcagcaacatgggtggaactggaggtctttgttaagttaaacaagccaagcacagaaagacaaatatcacatgttctcactcatgtgtggaccttaaaatagtggatcccatggagttagagagtagattggtggttactagaggctgggaagggtgggaggaagggagagatgaagagaagttgattaggtataaatatacaattagatagtaaaaataagacctagtgttagtacaatcaatagggtgactttagtttacaatgatgtatttctatttcaagacagctaggagtgaaaaatttgaatggttctagcacaaagaaaagacgcatatctaaggtgatggatatcctaagtacactgatttaatctttacaaactatatgaatatattaaattatcacatgtatcccaaagccgtgtacatctgttaagcaccagtaaatttttataaaaaaatattttatcttgattctgagcgttatctttgggggaatccacatgaccaaacactctgcaaccataacctgcagtttctctctccttgtatctttttaatggatggattaatcaaatctgaatccatctagaaggggaattagaagacatctatgactctgacttgtctcttgtagccaatggatttcctcttgaagctgtttaaaatagaattgggggaccacttgagacccctttgagacatgttattctgtgactcctaaaatcattttctgcataatatttaaaactcttcctgaaaccagcttctggaaattataatgcagagccttctgaagactccaaattacgaaactggggtctttctaggaggccagcaaagtgcttttctctttattaattagctgttcctgaaaggttcagttctactcatcttgttttctggtctcactgaattttgaatgaactaagaaacttcaccaaacttacataaaggcagcaagtatttctagatgtgtatgttgtcttaggaaaacattgctcattgacaaattatacatttaaacttatgggatgggtgggatgattgtcaagcaaggtatggaaacccatggttggtaatgaagatgtttgtctggctgccaaaaggattttatttttgtgacattagaacaagaaacaggtttaaattgtacacgatccaagctacatattcattaggagtgatacggagaagtggagccattgtgagctgaagcaggaacagtttcttagcattaacttggtcattggctgtgttaaaatcactctcctggagccattgttataactaagttttgactataagtgtcattggcaggagcaaaaaatgaagggggggagatattgaatataaagaataaaggcctgtggtggggtgggatagaaaaaatcttttaacataggtctcagtaactgcccttttggggaccaatatttgttcctttccttggacctctgtgctaaataaattaagaaaatatacttcaaaaaactttgaaattggcaggatgctggcttacccctgtaatcccaacactttgggaggttaaggcaggaggatcgcttgaggctaggagtttaagagcaacctgggtattatagtgagaccctgtctctacaaaacaataaaaagattagctgggcatggtagcatgcaactgtagtcccagctcctcgagaggctgaggtagcaggatcgcttgagctcaagaattagaggcagtgagccataactgtgccactgtacttcagcctgggtaaacagaaagagactcagtctctgaaaaaaaagaatctttgaagtttcaggtggtgggtatagtaaaagcccagacatcaccactatgcaatatatccaggtaacacaactgcacttgtacacttaaatctataaaaataaaatttaaaaaattctttgaaggttttaatagttgcagaggtgaaagatttgtttggtatttgttctgactgcagaagggctccttctagctttctttttcccagtttctctccagcaaactagctggtctgcagtttggcctgtacatccaatgtatctttcagttttctcctaattgcctttcactacagtctcccttgtttttgagagcacccctaggcttgaacttctccatactttgttgcaaatgaagtcagttcctttggggaacgatctgatgctctctcttctatggtctgcttctctcttgggcaaaatctctaagctatggttctagttcttggggtgagaacaaggcacacttttctctgaggaacgaccctatgttagttgctgagtgcttggtagaggggtgatggcagtggccccaggtctcctcagcttgcatttttgagcatggaccactgctccattagccagatcaagagaacttgaggccacagtactctcagcagtgctattcccaagttagagtctccgtgccgtaagtgagggctgggagcaagaaaggaagaaactctcagccaaagttgcttagaatttagctcagcaacaggtagcttattcctggatgagaaatgctgacgtcgtgccttacccaggaagatagctcttcagctgggagatgggggaagagagagccctgtgttcttggttgcacacatctagaatagagtttctgtttcactgagctggcaggtgggtgggaatggttctcggtttaaatattctaacctcttgctttcttactcagttttagtagattttcttgaatacattttttcttgaataatttttttttgattttatgtatgcccataggagcattttcagaaactttatttcgttgtttcaaaaataaattttagaccaggcatagtggctcacacctgtaatccaagcacttagggaggcaaaggcatgaagatagcttgagcccagaaatttgagaacaggctgggcaacgtagccagaccccattcttcacagaaaggaaaaataatgataataaatttccatttcactgaggagcaggtctgcagagttcttcatgttttcatatcagaagtgaaacttctagtagctttttttgtagattcattagataatatgcttaaatgattatgtcctataggaagaaagaccattttaattcttcctgtgcaatatggatgctcttttttctttctttattgcactgagtagacttcacatataatgttgaatagacatggtgaaagcagacaccattgtcttgttcctgatcttagggagaaagggttcagtctttcaacattaaatatgatgataggtgtaggtttttcctagatgaaatttatcaattttgggaagttttcttctactcctagtttgctaaaagtttttaacaggaacgtcagaatttttcaattgttctttctctgtctattaggctagttatataatttttctttttagtgtgttgacacagtaaataacaatgattgatttacatatgtttaggccaaacttcattctcatgataaatgtcacttctatcttaattactatatatttatgataggtttgatatctggtaatataagtcatccagccttgttattttcaagattatcttgactattcatggcctttcaaatttctagataaattttataatccgcttatcattttctgagaaaaaaatctactcaggttggcttcatattgaatatataagtaaacttgtggagttttaaaaaatctttataatactgaatgttctaattcataaattagtatattcctcttaattttattctgtaattcctctgaataatgttttggccttttcactttcgaggtcttacatatttttgcttgatctatgccttgagatatgatttttcatgccattttgagaatttgttcttcaatataggaggattagggcaaaagaaggataaaataacatttgttatagctatgtagagatatgattggttttacacattgcccttgtatctggaagcctttttctactgacttactaattccaacatttgtctacaatttcttttagattttctgcatacaaattcatatcatcttcaattagagtagaacagaagaggtaatagcagctatccttgttttgtttcttatttcagtggaaagcttttgatatttcaccattaataatggaatttgttgtaggtttactttgtaaatttttttatatgattaaggaagttcttttctccgtgtttcataagcactgcaaggctacaggatattttgttctccttttctgaaattttggcctgcctcttcagcgtcttgtgcaacctcagaattcagcaaatgttctgtgagaaaagctgccatgtatataaaatttttcaattttattataccagtctcatgtatccactaaaagctttggtgctttctaccaggatcacacccagatctttcgcctctaagcaatgccaaggatcacaaaattgccccgggaagaaaaacaatggccaattctcagctcacagttcttatccaaatgattttactacatgtagtaatctacacaaacttggcttgtgcaaagggagttgtgatgggtggataatgtataccattaggaagaaattttcagtaagtagcatgattaaagctgctgaatttgaattcccaagcctccaaagagaatttttgaccataaaattttaaaatgagaagcaagatgatgcttgtgggttaaagcaaaaacactagggcctgggtcctgctcattataaggcagcttttgtctacacaggcctctgcgttggcatggatctttgccccttcaaacagggtttgcaccagagaacagggcttttacaggcaggcagaccaagaggtcagtccgttctctgccggttgttccagctgtctaatcatggagcactttcttgttctccccaagtctgttttctcatctgtaaaaaaaagggtcgagataccttgccaagttgttctgaggattaagaaaataaattatgtaaataacctatcaaatagatgctcagtaagtgggagtttgttttcttccctttcttccacctaagtactgggaaagaaagtgcttgagaaagtgcttgctgtaactgaaataatgaacacaaggtggacagaaagggcataacctctcccaattagcaatcttagcatagctttttttgagaaatagttttcactctccaccagaaaaaggaacccagggaatgaattagtggttgtaggcattctgtcttctatgcattatgaagagagaagccatattaataagataactgaaaagtcacgttagtaagatatttgacagaacaatgtttatagtattggataagaaacagcacacagaattgttttcaaattgaaaagtagatgtgatcttgtgtttaagaaagactcctttgacattcaggagataactacagcattttgatgggctgttttgatttctagctaaaaggaagttaaataggaaatgaatcatcaagttaatgggcatagtggtgaattaaagaagatgtgtggtagtgtaacacaccaactcaaaacttggctgatggggcacttaactcttcagagaaaactttaatgactaaatgtagatttatttaacattaattaggtatatattaaaacctaaagataagtttattcttgaggcaattccagattattattgatcatagtacatcaggggtttggtagtcattggagtgatgggaacagtcttggactgagaggagactttagttatatagctctaccagcatgagttgtcaactttggttaaatctcttcctgtccctttacttgttgacctgtaaataagtttagatttcacctccttcattcttcagtttgattattctaaaatggtaaatttattgttttactgctatacttgggcccctactgtgcaatagctggctggtatgaaattaagtgtggtatttgatatttactttaccaaggagtgcattctgtgtgtccctgggcaaacaccttcatggaatttcaactcattactgaattactctgcatcgcagaacacttccagttgaagtgcctgtaaaatcataagatgtccatgagctggttagtgaggtacagaatgttaactcatgaagaaacttccaaattttttcccaaccagcctctctttgaggacgataatcccttttgtagcactgctgatacttagctatctagcttctgcttgattacctctaattcgtgagttagtgctcccactttaaaccttcctaagaagttctgtagatggtccctttgaattcatggtgccagttttaattatgggagagttggcttttttttttttttccttccaaagtctgtttttatgtgatgagcctctggaaatttgaggggaattctatctttagtgtcttcaagtgtccttcatgttttctggtttcagggtgtttcacagtcctgatcactgtcttctcagtcaacattcctcaaactgtgttccactgaatgttaacatcctgtgagaaatcaacaagtgacccagtgttttgaaaaatgaaattgttttgtcaaatgtttaggtagcttaacaaaggcaaatgggtttttaatgcaagactacaaagattcctttttatgttaatattaattatgaatacataggaaacagttttctttttttattatacttttaagttctagggtacatgtggacaatgggcaggtttgttacatatgtatacatgtgccatgttggtgtgctgcacctattaactcgtcatttacattaggtatatctcctaatgctacccctcccccctccctgcaccccacgacaggtcccggtgtgtgatgttctccacgctgtgtccaagtgttctcattgttcaattcccacctatgagtgagaacatgcggtgtttggttttctgtccttgcgatagtttgctcagaatgagggtttccagtttcatccatgtcccaaaaaagaacatgaacgcatcgttttttatggctgcatactattgcatggtgtatatgtgccacattttcttaatccagtctatcattgatggacatttggcttggttacaagtctttgctattgtgaatagtgccacaataaacatatgtatgcatgtgtctttatagcagcatgatttataatcctttgggtatatacccagtaatgggatggctgggtcaaatggtatttctagttctagatccttgaggaattgccacactgtcttccacaatagttgaactagtttacagtcccaccagcagtgtaaaagtgttcctatttctccacatcctttccaacacctgttgtttcctgactttttaatgatccccattctaacaggtgtgagatggtatctcattgtggttttgatttgcatttctctgatggccagtgatgatgagcattttttcatgtgtctgttggttgtattaatgtattcttttgagaagtgtatgttcatatcctttgcccactttttgatgaggttgtttgatttttttcttgtaaatttgtttaagttccttgtagattctggatatcagccttttgtcagatgggtagattgtaaaaattttctcccattctgtaggttgcctgttcactctgatggtagttacttttgctgtgcagaagctcgttagtttaattagatcccatttttcgattttggcttttgttgccattgcttttggtgttttagtcatcaagtccttgcccatgcctgtgtcctgaatggtttcacctaggttttcttctagggtttttatggttctaggtctaacatttaagtctttaatccatcctgaattaatttttgtgtaaggtgtaagaaagggatccagtttcagctttctacttattgctagccagttttcccagcaccatttattaaatagggaatcctttccccatttcttgtttttgtcaggtttatcaaagatcagatggttgaagatgtgtggtattatttctgagggctgtgttctgatccgttggtctatatctctgttttgataccagtaccatgctgttttggttactgtagctttgtagtataatttgaagtcgggtagcatgatgcctccagctttgttcttttggcttaggattgtcttggctatgtgggctcttttttggttccatatgaactttaaagtagttttttccaattctgtgaagaaagccattggtagcttgatggggatggcattgaatctataaattaccttgggcagtatggccattttcacgatactgattcttcctatccatgagcatggaatgttcctccatttgtttgtgtcctcttttatttcgttgagcagtggtttgtagttctccttgaagaggtccttcatgtcccttgtaagttggattcctagatatttcattctctttgaagcaattgtgaatgggagttcactcatgatgtggctctctgtccgttattggtgtataggaatgcctgtgattgttgcacattgattttgtatccagagactttgctgaagttgcttatcagcttaaggagattttgggctgagacgatggggttttctaaatatacaatcatgtcatctgcaaatggggacaatttgacttcctcgtttcctaattgaataccctttatttctttctcttgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacattccatcaatacctagtttattgggagtttttagcatgaagggctgttgaatattgtcaaaggcgttttctgcatctattgaaataattgtgtggtttttgtctttggttctgtttatatgctgatttacgtttattgatttgtgtatgttgaaccagcctggaatccctgggatgaagctaacttgatcgtggtggataatctttttgatgtgctgctggattcggtttgccagtattttattgaggatttttgcatcgatgttcatcagggataatggtctaaaattctccttttttgttgtgtctctgccaggctttggtatgaggaagatgctagccccataaaatgagttagagaggattcccccttcttctattgattggaatagtttcagaaggaatggtaccagctcctcattgtacctctgctagaatttggctgtaaatccgtctggtcctggactttttttcgttggtaggctattaattattgcctcaatttcagagcctgttattggtctattcagggattcaacttcttcctggtttagtcttgggagggtgtatgtgtccaggaatttatccatttcttctagattttctagtttatttgtgtaggtgtttatagtattctctgatggtagtttttatttctgtgggatcagtggtgatatcccctttatcattttttatcgtgtttatttgattcttctctcatttcttcttttttagtcttgctagcagtctatcaattttgttgatctttcaaaaaacctgctcctggattctttgattttttgaagtgttttttgtgtctctatctcctccagttctgctctgatcttagttatttcttgccttctgctagcttttgaatgtgtttgcccttacttctctagttcttttaattgtgatgttagggtgtcaattttagatctttcctgctttctcttgtgggcatttagtgctataaatgtccctctacacactgctttaaatgtgtcccagagattctggtatgttgtgtctttgttctcattggtttccaagaacatctttctttctgccttcatttcgttatgtacccagtagtcattcaggagcaggttgttcagtttccatgtagttgagcggttttgagtgagtttcttaatcctgagttctagtttgattgcactgtggtctgagagatagtttgttgtaatttctgttcttttacatttgctaaggagtgcttttcttccaactatgtggtcaattttggaataagtgtgatgtggtgctgagaagaatgtatattctgttgatttggggtggagagttctgtagatgtctattaggtccgcttggtgcagagctgagttcaattcctggatatccttgttaactttctgtctcgttgatctgtctaatgttgacagtggggtgttaaagtctcccattattattgtgtgggagtctcagtctcttttaggtctctaagggcttgctttgtgaatctgggtgctcctgtattgggtgcatatatatttaggatagttagctcttcttgttgaattggtccctctatcattatgtaatggccttctttgtctcttgatctttgttggtttaaagtctgttttatcagagactaggattgcaacccctgctttttttttttttccatttgcttggtaggtctttctccatccctttattttgagcctgtatgtgtctctgcacgtgaaatgggtctcctgaatacagcacactgatgggtctagattctttatccaatttgccagtctgtgtctttcaattggagcatttagcccatttacatttaaggataatattgttatgtgtgaatataatcctgtcattatgatgttagctgtttattttccccgttagttgatgcagtttttcttagcatcgatggtctttacaatttggcatgtttttgcagtggttggtaccagttgttcctttccatgtttagtgcttccttcaggagctcttttagggcaggcctggtggtgacaaaatctctcagcatttgcttgtctgtaaaggattttatttctccttcagctataaagcttagtttggctggatatgaaattctgggttgaaaattcttttctttaagaatgttgaatatcggcccccactctcttctggctcgtagagtttttgctgagagatccactggtagtctgatgggcttccctttgtgggtaacccgacctttctttctggctgcccttaacattttttccttcatttcaacattggtgaatctgtcaattatgtgtcttggggttgctcttctcaaggagtatctttgtgacgttctctgtatttcccgaatttgaatgttggcctgccttgctaggttggagaagttctcctggataatatcctgaagagtgttttccaacttggttccattctccccatcactttcaggtacaccaatcagatgtagatttggtcttttcacgtagtcccatatttcttggaggctttgttcatttctttttactcttttttctctaaacttctcttctcactccatttcattcacttgatcttcaatcactgataccctttcttccacttgatcaaatcggctactgaagcttgtgcatgtgtcacgtagtcctagtgccatggttttcagctccgtcaggtcattaaaggtcttctctacactgtttattctagttagccattcgcctaatcttttttcaaggtttttagcttgtttgtgatgggttcgaacatcctcctttagctcggagaggttggttattactgatctgctgaagccttcttctctcaactcgtcaaagtcattctctgtccagctttgttccgttgctggtgaggagctgcgttcctttggaggagaagaggcgctctgatttttagaattttcagcttttctgctctggtttctccccatctttgtggttttatctaccgttggtctttgatgatggtgacgtacagatgggattttggtgtggatgtcctttctgtttgttagttttccttctaaccgttaggaccctcagctgcaggtctgttggagtttgctagaggtccactccagaccctctttgcctgggtatcaccagcagaggctgcagaacagcaaatattgcagaacagcagatgttgctgcctgatacttcctctggaagctttgtctcagaggggcacctggctgtatgaggtgtcagtcggcccctactgggaggtgtctcccagttagtctactcgggggtcagggacccacttgaggaggcagtctgtccgttctcagatctcaaactccatgctgggagaaccactactctcttcaaagctcagttagaaatgcagaaatcattcgtcttctgcattgctcacgctgggagctgtagactggagctgttcctattcggccatcttagaacctccaggaaacagttttcatatgtagtcttttttgaccttgggcctttttctcccctccacaaaacacctaatcacttctcacttgggatacaagtcatccatagatcagcttgaaaaatgctgctctgtaatctaccaggtttattaatatccagcctaaggtgtgttatctagtaaagaacacaatactctggatgctttcaagctatctcacagaacaacaggactatcacctctcccattttacacatcacacttccattaatgtaacctaaaaataaaattggcctatttggtgatggcattgcccacttggcttaccttaatgctttttgatcaattaaaatctagtagattattttttttacaaccattgaccagccaatctcctcaatcctatgtatcctagtatttatttttggagacaaatgcaagaatttctatttatccgtattaaatttcaccttatatattatactctaataactccaagccacataaagctttctatttcttttattcaatgtattgactataatttttatctgtatcattgaatcatgtcttctatgtctttatttttagtataattatttaaggacaaagcctgatattagccattagagactatatcagtgttttatattgacctactaaacaaaatctttggatatattttaaccagttaagaagccatataaatattctctaatctatttaatttttccatgtagcataatggacacatgatatagtctgtcagtgccttgatgaaattcagatacacaatgtcaacagcttctctctttgatgtgaaatgtgtggcaattttgttttccataaaagttaggcttggcataatttgtttttagtgaatccatggtagctcctgctaataattatctgtttttccaaagcttacgtatttttgtttaccagtctgacccagaattttactgctgattgatattgatattagccttaataaagaaagtattctatataactaattaagcctatcttcccaagctattgataatgacacagcacagttaaagtaagaacattctttttggcattgggataattttccagcctctctgttgtctgattccaccaacaaataaatgagcttcatgacttccatcactgccacagggatgttgatggattaaatcattaattaattcatttattaagttcctttaataaggcagatactctgctaagtgctctggggatgtaaggttggataagacatagtgtttttcttaaaatcatataaattagaaatagtagctcaatgagacaaagggctagtttccaaagctaagctgtttgaattatgttaagggaaacaaacgtatccttggtctcttaagagtttctttgttctattttctctaaatacagattttatgcccaggtagactctgtgttttaggttcctcaaaaaagaccagtgtaaatgtaaacagtattaagcacacaagcatgattagagaaaaggttggtgttaatatttttttaacagaaagcaattacagtttaatcctctcattacaaaagttgcttcaaagaatgtgaagaaaagaatatatctgataatatattactcatttataagctgctactagtgcagaaggaattctttctttaattggaagaaaaaacaaagagattcccaggatccttgttacccttcatgaatgctggcagggcactttcacatccatttagtccttacttttatgtaatattctgttctcaaaacattgctgggaaagtgagaaggttatagatggtaaaactcagggtcatagcagagaggaaactttcccgttcaaggaatagaacattggcctcttgaattccagtccagggtgtttactgatcccccgctgctacttgtactagaactgacattcaaaatgaagtaaaaaataaaagtaagacagattaaacaaacaaaaaaacatgctcagaatggctatgagtgcaacactgaatgatatcccactccaaagaattcggtagtggttgatggagacaaagccattaagatgactttaattaagagttgactttgaggctgggtgcattggctcacgcctataatcccagcactttgagaggctgaggcaggcagatcacgagatcaagagatcaagaccgtcctgaccaacatggtgaaaccccgtctctactaaaaatacaaaaattagctgggcatggtggtgcgcgcctgtagtcccagctactcaggaggctgaggcaggagaatcgcttgaacctgggaggcggaggttgcagtgagccgagattgcgccactgcactccagcctggtgacagagcaagactttgtctcaaaaaaaaaaaaaaaaaaaaaaaaaaagagtagactttggcctggtgcagtggctcacacctgtaatcccagcactttgggtggccagagtgggtggatcacctgaggtcaggagttcgagaccaacctgaccaacatggtgaaaccccatttttactaaaaatacaaaaattatctgggtgtggtagtgtgcacctgtaatcccagctactggggaggctgaggcaggagaattgtttcaacccgggaggcagaagtttcaatgagccgagatcgtgccattgcactccagcctaggcaacaagagcaaaactccatctcaaaaaaaaaaaaaagagttgactttatttattttaaattatttattgtggtgaaattcacataacataaaaaggtaaccattttacgggaacaattcagtggcatttagtacatgttcacagtgttaggctaccacaacttctgtctagttccaaatcatttccatccctccaaagtaaaaccccttatccattaagcagtttacccctgtttctcctcttctcagcccctggcaaccatgaatttgcattctctatgtcctcacccattctgaatatttcgtatagatgaaatcatacaatatgtggccttttgtgtctgctttctttgatttagcaagatatattggaggtacatccatgtatcagtacatgtatcagtatgtcattcttttttatgaatgaataatattctattgtatggataaaccacaatttgtttatctgtttattcattcataaacatttgaggtgcttccattttttgctaatgtaaattgtattgctgtaaacatttatgtataagcttttgtttgaacacctgttttcaggttttatacctaggagtggaattgtggggtcatgtagcaattctatgattaaatgtttgagaaacttttaaattgttttactttattttttgatggagaggagaggagtggcggggagaagagaggagagagtagggaaggacagggaggaaaggaattcagcatgtttgacatgaaggtctgtgtactttgtataaccccaatatttgtcattgaaaactgtgaggagggttctcttgcacaaacacctaactaggaaaacggagaaatgttcatggacatttgcgaaatcactgattggtggagagggatgctacatagcaacagaaagactgcagtcttttgttactactttgtttcactttctgcccaagagatccaattaaattaatgcctaaaatcaatctccaaagagtaggtttgaatttggaattagaccgaagggatgcctgaggactaatcaaggaagtcatatgacaacagtcttttccaagggccctcagcactcacaatgatgcccatgagacttcaatacagtggtgctcatattttgatgcactaaattcgattttgtgcactgattttgatgcacattggaattccctgatgatctttaaaaaatattgattccctgtattttaccgtaataaaaagcactgattcttggactttacccacagatgttctgatttgactggtggaactaggacaatcagaagatttaaaagctccccatgtgagtctaatatgtagccaagtttgggaatcattgctttaacctatgtgaggttatttaaccgtatgtgaggccctgcttgctgaagtgacaggaagatgttttatctttaccctatcttttccttcttattctccaccttgaatcatccaattttattcaaccatgtcttaatgtctatagcagagaagattctggaacatataaaaataaaacaatttgtgatcaaatagattaccaggtattcaaagggtaaacaaatgggaccataaaataatcaggcaacagagaaaaaaatgttttttgtttattttagcatgtttatttttggcccaagcctttatcaggttggagttggaggctggggaggaagaataacaaagcattgaggatatggagctctgagaagtttgatccctcctctgtgtgattaatgttaagaaagaccaaatcaaggtaactttaaagcagatatgctggatatccttccatttgtatacctacctatccatctttattttttttgttttttagattttttatttccataggctttgggggaacaggtggtattttgttacatgagtaagttctttagtggtgatttgtgagattttggtgcacccatcacctgagcagtatacactcaaccccatttgtagtcttttattcctcactcccttccaccctttcccctgagtcctcaaagttcattgtatcattcttacacctttgcatcctcatagtttagctcccatttatgagtgagaacatacgatgtttggttttccattcctgagttacttcactgagaatgatagtctccaggtctatccaggttgttgagaatgccattaatttgttccttttatggctgagtagtattccatagtatatgtatatacgacaatttctttatccacttattgattgctgggcatttgggctggttccatatttttgcaattgtgagttgtgctgctataaacatgcgtgtgcaagtgtctccttcatataatgacttctttttttctgggtagatatccagtagtgggattgctggataaaatggtagttctacttttagttctttaaggaatctccacactatttaccatagtggctgtactagtttatattcccaccagcagtgtagaagtgtgcccttttcactgcatctatgccaacgtctttttttttatgtttttgattatggccatcctttcaggagctaggtggtatcacattgtggattttatttgcatttccctgatcattagtgatgttgagcattttttcatgtttgttggccatttgtatatcttcttttgagaattgtctattcatgtccttagcctactttttgatgcaattgtttgtttttttcttgctatttttttaattcattatagattctggatataagtcctttgtcagatgtatagatttgtgaagattttctcctagtctgtgggttgtctgtttactctactgactgtcccttttaccgtacagatctctaggttaattaagtcccacctatttatcttttgtttttgttacatttgcttttgggttcttagtcataaaggctttgcctaagccaatgtctgaggtttttttctgatgtcatctttcagaatttttgtagtttcaggtcttagatttaagtccttaatccatgttgagttgattttcctataaggtgagagatgaggaccgagtttcattctcctacatgtggcttgccagttgtcccagaagcatttgttgaatagagtgtcctttccccattttatgtttttgcttgctttgtggaagatcagttggctgtaagtatttaagtttatttctgggttctctattttgtcccattggtctccgtgcttatttttataccagtaccatgctgttttggtgactatggccttatagtatagtttgaagtcaagtaatgtgatgccaccagatttgttctttttgcttagccttgctttggctatgtgggctcttttttggttccatatgaattttaggattgctttttctagttctgtgaagaatggtggtggtacattgatgggaattgcattacatttgttgattggttttggcaatatggtcattttcacaatattgattctacccatctataagcatgggctgtgtttctctttgtttacagtcttcttggcatatgatcatattagcaaacagtaacagtttgacttcctctttaccgattttgatgctctttattccattcttgtgtcggctctggctaggacttctggtactatgttaaatagaagtggtgagaatgggcatccttgtcttgttccagttctcagagggaatgctttcaacttttctccgtttagtattattttggctgtgggtttgtcattgatggcttttattacattgaggtatgctgactttgctgagggttttaatcagaaagggatgctggattttgtcaagtgctcttcccgcataaataaagacactttttctgcatctattgagatgatcatgtgatttttgtttttaattctgtttatgtggtgtatcacatttattgacttgcatgtgttaaatcatccctgcatccctggtatgaaacccacttgatcatggtggattacctttttgataagctgttggatttggttagctagtattttgttagggatttttgcatctatgttcatcatggatattggtctgtagttttctttttttgttatgtcctcttctggtttttgtattagggtgttactggcttcatagaatgatttagggaggattccctgtttctctatcttgttaaatagtgtcaataggattggtaccaattctactttgaatgtctgatagaattcagctgtgaattggtctggtcctgggtttttatggtttttttgtttggtaatttttttaaattaacatttcaatctcactgcttgttattggtctgttcagggtttctaattcttcctgatttaaggtaggagggttgtatgtttccaggaatttatccatctcttctaggttttctagattatgcaggtaaaggtgttcatactagctttaaatgatcttttgtatttctgtggtgtcagctgtaatatctcccatttcatttctaattgagcttattcggatcttctctcttctttttttggttaatcttgctaatgatctatcaattttgtgtatctgttcaaagaacaggctttttgtttcatttatctttttattgtttcttttttgtttcaatttcatagtctgctctaatcttggttatttcttttcttctgctgggtttaggtttggtccgttatttctctggatccttgaggtgtgacctttgattgtctatttgtgctctttcagactttttgatgtaggcatttaaggctatgaactttcctcttagcactgcttttgccgtatcccagaggttttgataggttgtgtcactattatcattcagttcaaataatttttaaatgtccatcttgatttcattgttgacccaatgattattgatgagcaggttattcaatttccatgtattagcatggttttgaaggttccttttggagttgatttacaattttattccactgtggtctgagagagtacttgatataatttcaattttcttaaatttatggagacttattttatgtcctatcatatggtctatcttggagaaaattccatgtgctgataaatagaatgtttattctgtgtttgttgagtggaatgttttgtaaatatctgttaagtccattttttcttgggtatagtttaaatccattgtttctatgttgacttggtcttgatgacctgtctagtgctgtcagtggagtattgaagtccctcactattattgtgttactatctatctcatttcttaggtctagtagtaatcgttttataaatttgggagctccagtgttaggtgcatatatatttaggtttgtgacattttactcttggacaaggccttttatcattatataatgtccctctttgacttttgtaactgctgttgctttaaaatttgtttgtctgatgtaagaatagctactcctgctcacttttggtgtcaatttgcaaactccttatttgttaggtgagtctcttgagggcagcagatacttggttggtgaattcttatccatttcaattctgtatcttttaagtggagcatgcaggccatttacattcaacattagtattgatatgtgagctactattccaatcattgtgctatttgttgcctgaatacatggttttttaattgtgtttttgttttataggtcctgtgagactcatgctttaaagaggttctgttttgacatatttctgggatttgtttcaagattcagaggtccttttagcttttcttgtagtgctggcttggtaatggtgaattatctcagcatttgtttgtctgaaagagactgtatctttccttcatttatgaagcttagtttcactggatacaaaattcttggctgataattgttttgtttaaggaggctgaagcgagggccccaatcctttctagcttgtagggtttctgctgagaaatctgctcttaatttgataggttttcctttataggttacctggtgcttttgcctcacagctcttaagattctctcctttgtcttcactttagataacctgatgactatgtgcctaggtgatgatctttttgtgatgaatttccaaggagttctttgagcttattgtgtttggatgtctagatctctagcaaggctggggaagttttccttgattattcccccaaatatgctttccaaacttttaaatttcttttcttcctcaggaatggcaattattcttaggtttgttcgtttaacataatcccaaacttcttggagtctttgttcattagttttaattcttttttctttgtgtttgttggattgggttatttcaaaaactatgtttttgagctctgaagtgctttcttctgctttttctgttctattgctgagacttttcagtacagtttgcatttctctaagtcctgtgatgtgaactgtcttcaggtctctcagtcatggatgcctgcacctgctccagtggaggtggcagcggaatgaaatggattctgtgaggacccttagttgtagttgtttaacacactaattttgtgctggttggtctcctgccaggaggtgttgctttcaagagagcatcagttgtggtagtacaggagaggatcatgtggtggggggggggggggtcggggggcgggcctaaaactcccaagagaatatgacctttgtcttcagctaccagggtgggaagggaaggaccatcagctgggggcagggttaggtgtgtctgagctcagactctccttgggtggtgcttgctgtggctgctgtgggggatggaggtatggttcccacctcaatggagtcatgtttccaggaggattatggctgcctctgctgtatcatgcaggttgtcagggaagtgggggacagccagcagttacaggcctcacccagctcccttgcaacccaacaggccagtctcactcctaccgtgctcccacaaatggcaccgagtttgtttccagacagtgggtgagcaaggctgagaacttgtctcaggctaccagcttcccagctgagaaagcaagcagggctttcacgcctcctcacctgtcgaatctgcacaccagattcatgccttcccctgagttctggccaggaaacttcacgtttggatggaattgttacaaagttcagctgggggtttccttctccctgtggtattttcccaatttctctggcagccctccccaaagacctctgtgagacaagtcagaaatggctttcctgaggactcagagagcccacaggacttcccgctgcttcctctacccctgtattttgcgtggctctctaaattgtctcagctccaggtaaggtcaaatccttctcccatgatctggaccttcaggttcctcagtgagggtgtgtgtttgggggcagatgatccccctttctcactttcacagtttgggcactaacagtattccggctgtctcccgggtcctgcaggagcaatctgcttccttcaaaaggtctgtgggttctctcagctttcctggtatattcctgcagtagttcttggaccagaagttcatggtgcgagtctccacatgctgctctgtctgcccgagtgggaactgcaatttggtcctgcctcctatccaccattttttttcctagaaaaaaaatctttttattcaacacattttttgattaccagctatgtgccaaccattgtacttaatgtagaggttagcttggtaaataaaatggccaaaaatttctacttcatgatatttgcaatctggcatgtgagacagacaaacattaaagaaataatcatacaatttctaactataaactgtgacgtgaaatagaataacagtaatacctaattcagatttaggaaaaacagagagaatgcctctctgacgaagtgccatttaagccaagacataaagagtgagtgagagttcaccagacagagctttccaggtggagggaatagcacatgtgacaaatctgagatgataatggccttgttacattccagagacaaagaaacaaaaacaaccagttgggatgggctgtagaaaggacatgaaattagaggggtaggcagaagccagatcatgtgggaattatacggcttggtaaagacttgagttttattcaaattatgttatgaagccatcagaaggttttaacacagggaagtgataagatcttacttactcttaaaataagattttattctagaaaatggacaacttgacagtttcctttatttatccaattcagcaattatttattgttctgttgttttattgggttctgggtgggtacaaatgagcaatatatgattcctgccctcaagaagctaaatgtagttgacaaggcagaactctgaaaacataaaattatgatagggtgtgataaatgcaacaggagaagtatgtatgtggcactgagagaaaaaagacaaatactctgattgtgttagcagttggtgggtcgacgtgtcatgtagcagggaagtcctggtgtgcttggatgtggtcagataaatgagcccgtctgaatgaactgttagtcatacttttgacctcatgatatcttcctttcctgggactcattgcatcctgggcaaggagcttgattatgatggtcctgtgttccctgctggaatcttaaatagtgttaatgaccatcttcctgggtaagactgccaaccaggttcctcagtgcttatttgaaacctaggaatgggtctcagctgaccagaccacttatcgaaaggaaagacacctctcttcatccccccaactttagcacaaacaccataaagacagcctgcactgtgttcctctgtgagcctagagctcaagttctactgatgcaaatatatctgaaggggaaaggatgtggttttagcataaccagtacatttctcaggcagtcgctgcagcagaaatagcaataaatagcagtagggatgatggcagatattagagccaaaaatgccagtttcagttccagcaattacattcaggtaatttctagctagagtaaagtcaaggccagtaatggaggtactggaaatagcatttccttaaaaacctgagagaacatacagctagtatctgtgctgagcgcagactgggcagacctggcttgtaggctgcagaatgtggagtccagggataacagatttgagaggcaaatggtgcaacttaagcaccaatataaagggactgaacataaaggcacagactaattataaggcaacaagatgcaaagaaaactcaccagacaggggtaactgagaggtgctttgagacactgggaagtgaaagggaattgttaacatcttagattagtgatccccaaactttgctgatcatgaaaatcatctagaaggcttgcagaaacctgaattccagggttccattaagaccaccaaatcagtatttctgggactaaagctgtcaatccatatttttttcagaattttacatttttatttaatgtatggatatttttatacattttatttatttatttttccttccaacttttaggttcagggagtacatgtgcaggtttgttacatagacgaattgcatcacagtggctgaactactttacattcccaccagcactgtataaagtttaccttatacagtatataataccatctcacaccagtcggaatggctatctcattgtggctttgatttgtatttctccaatgattagtgatgttgagcattttttcatatgcctgttggttgcatgtatgttttctttgaagaagtgtctgttcatgtccttttcccattttttaatggagttgtttgattcttgcttgttgatttgtttgaattctgtatagattatggaaattagatctttgtcagatgtgtagtttgtgattatttttcccattctgtaggctgtccatttacatttttgattcttttgctgtgcagaagctcatcagtttaattaggtattatttgtcaatttttgttcttgttgcaattgcttttaatttctttgtcatgaaatatttgccaggtcctatgtccagaatggtatttcccaggttttcttcaagggtctttatagttttaggttttaaatttaagtctttaatctaccttgagttgattttgtatatggtgaaaagaaaacgtatagtttcgatcttctgcatatggctagccagttatcccagcacaatttattaaataaggagacttttcgccattgcttgttattgtcaactttgtcaaatatcacatggttgtaggtgtgtagctttatttctgggttctgtagcatgttctattggtctatgtgtctgtttttgttctagtgccatactgttttggttattgtagccttatagtacagtttgaagtagaacagtatgatgcctccggctttgttctttttgcttaggacttctttggctatttgggcttctcattgaatctgtacattgctttggtcagtatggccattttaagaatattgattcttcctatccatgagcatagagtttttccatttgtttgtgtcatctctgatttcttagagcagtgttttataattcttgttgtagacagagatcttttacctccgtggttagctgtattcctaggtgttttattcattttgtggctattgtgaatgggattgcattcttgatttggctttcagcttggatgcttttggtgtacggaaatactactgaaatttgtacattgattttgtatcctaaaactttgctgatgtttttttttttatcagctctaggagtctgtggcccaaaactatggtgttttctaggtatagaatcatatcatccatgaagagagatagtctgactttctctcttttatttggatgtctgtcttctatttccttcttttgcccgattgctctagcaagaacttccagtgaatgtgttgaataggagtggtgagagtggacatccatgtcttgttcttgttttcaaggggaatgattacagcttttgcccattcagtatgatgtttgttgtgggtttgtcattggtgactcctattattttgaagtatgtctttgatgcctagtttgttgaggttttaacatgaaggaatgttgaattttatcaaaagctgtttttgtgcctattgggatgatcatgtggtttttgtttttatttctatgtgatgaatcacatttattaatttgcacatgttgaaccaaccttgtatcccaggaataaagcctagttgattgtggtggattagccttttgatgtgttgctggatttggtgtgctagtattttgttaaggatttttgcatctatgtttatcagggatattggctgaagctttctttttgcattgtgtttttgccaggttttggtatcagaatgatactggcttcatagaatgagttagagaggagtcccttctcctcattttttggaatagatggtaggattgttacaagctcttctttatacatctggtagaattgggccatgagcacatctggtccagggctttttctggttagtaggtattttattattaattgaattttggaactcattattgatttgctcagggtttcaatttcttcctctttcaatcttgggaggttgtatgtttccaggaatttatcagtttcttccaggttttctagtttgtgatcatagaggtgctcgtaatagtctctgagagatttttgtgtttctgtggagtcagtgataatatccccttagtcatttctgatagtattcatatggatcttctctcattctttctttattagtataattagtggtctttcagtcttatttattcttccaaagaaagccttttagtttcatggatcttttgaatgttttttttaatctcgattttcttcaattcaactctgattttggttattgtttttttcttctgctagctttggagtagtttactcttgcttttctagttcctctagccatgctattaggttgttaatttgaaatctttgtaactttttgatgcaggtgtttaatactataaactttcctattaacactgctttagctgtgtcctggagattctggtgtgtcatatctttgtatattgtttaatttccatgtaattgtatggttttgagagatattttggtattgatttctatttttattgcactgtgatctaaaagtgtcattggtatgatttcagtttttctgtatttgttcagatttgctttacagttaagaatgtagttcagtttaggaattgtgccatgtttatatgagaaaaatgtgtgttttgttgttgaatggagtgttctgtaaatatctgctaagtccatttggttaagtgtcaagtttaggtcctgaatgtctttgttagttttctgccttgattatctttctaacactgtcagtggattgttgaagtctctcactattattgagtggctatctaagtctgtgtgtaggtctctaagaacttgtttaatgaatctggctgttccagtgttggttgcatatatatttaagatagtgaagtcttcttgttgaattgaaccctttaccattatgtaatgcagttttttgtctttttcttatcattgtcagttcaaagtctgttttgtctaaaattagaatatcaactcctgctttttttggatttctgtttgcttggtagatttttctctatccctttactttgagcctatgagtgtcactgcatgtgaaatgggtctcttgaagacagcattacagttgagtcttgcttctttatccaacttgccactctgtgccatttaattgggacatttagcccatttacattcaaggttaatgttgatatgtgtggatttgatcctgttaccacgttgttaactggttgttatgtagacttgctttgtagtgttaattgtctatgtacctgaatgtgtttttgtcgtggcagataccagtcttttgtttctgtgtttaacactcctttaaggacctcttgtaaggcaggtctggtgggaatgaattcccttagcatttgcttatctgaaaaggatttaatttctcatttgctaatgaggcttaatttggctggatataaaaatctttttttttttctcttttatgatgctgaatatgggcctccaatctcttctggcttatagggtttctgctgaaagatgtgctattagcttgatgatgttccctttgtaggtgacctgccccttctctctagcttctctagctgcgtttaatatattttcttttatgttgacctttgagaatctgatgactatgtgttttggggatagtcgtcttgcatagtatctcacagggattctataaatttcctgaatttgaatgttgatctctccagtgaagttagggaaattttcacaggcaatatgctgaaatatattttccaagttgattgttctctctccctctctttgagagatgccaatgaatcataggttttgtctctttacataatcctatatttcttgggggttttgttcattctattttattcttttaaaaagatttttgctgactgagtttattcaaaggtgcagttttcaagatatgagaatctttcctcagttttctctattctgctgttaataatttcttctgtattacaaaattcttacagtgagttttttagctctattagatcaatttggttctttcttaaaatggctatttcatctttcagctcttgtatgttttactggattccttagattccttggattgagtttcaactttcttcacaatcttgatgacctgcatgctgaattctatgtctgacatttcagccatttcagcctggttaggaaccatttctggggaggtagttcagtcatttggatggaagaaaacactcaggctttttgagtttccagagttcttgagctggttctttctcatctgtgtgggctggtgttcctctaatctttgaagttgctgtcatttggatggggcttctgcttttatatcttttgatgccgtttagggtttgactgtgctataggttggattcagtcaactggcttcatttctggatgatttcaggtagccaaggcttagttcagcattcctgggctgtgtgctctaatcctggagggctgagaccaggccctctgctttgttgtctcgcccctcaagcttatgtacctgctggactggaggggctgagatgttcctgatctgccagcaataacattgttgggaggtcctggcaaaagtgcttaatcagggcagcagctgcagggtttgtgcgtatgcatgccagcagcagaagggcagccggtcagttgggtccacatgcatgccagcaaagcagtggaaggatgctgtgtgtgggtacacccagtagtgatccttctgcaaaagctctctgatggctaggcagggtctgccagtaaagcagacatggtgatggctgctgggaagtgccctggtttggcatctgatgctgtgctgcaagtaggtgcagccaggcagggaccctgggaaaggccagcagaccaggggcactcagatcagactggccttatcctataggcaagatgtccctgttccatccaggtgggacagtcaacaaaggccaaggccacctagaggagtgtggcaagctttggtggatgggcatccctggctgtgctccactgtagccattctcacgccaaaccctctgtgctccacaaaggcagaagtcctgtccctgccaactacccatgaagctctccttgccagctcaaatgtctgtgggtgtcatgggttctcccccagttaggattccagaggtctatggcgagagtgggctactccatgcctatttaactcaccccttctccatgagttactcaggaccaggaatgagccctggtgctcagtaaccctgtgcagggttcctagcttcctcctcatttcacccctgactttgcatcttccctctgtcccctcttaatgcctttcttccgaagatatgctcagagtgtgccagtcttcttaatggtctggtctgttgatgggagaagctcttcctggctatgtctagtctgccatttttgctcttctccctacatcatattggctggtctccccatattttttaaataaactaaataaatgaccctcccctggaaattctggccctttcttttttcccaaatggccactacttctaagagtttctaattaatccataggagatgagtcatttcttcttcctcaaatatttagaatatttcacagaaggtgttaggtacaggaaaattctaccataatggatatgatagtactggtgataactagcatttagatagcactttacaatttcaaagtgccttttcacatccagcatcccttatttaatttactttactttactttaatttcgtttaattatcacaatagggccgtgaggtcaggtattgatatccccatttcacagatgtggaaactaagactaaaatgattaagagaatttagccaataaggagttgacccaggactcagtctcaggttttctgctactagatataggcttctttatacctcattcatgaggtacgaagggagaaatagtgaggcaggaataagagtgaacagtgtactctcacagaatgttccagtctgccactatctgaatatcaaaatttggtgggaggtgatatattttctataaaagggtactgaaacagaacagatctatgtcaaagctggggcaggcatgttggggcactgtaggtgtatatcaacttagaggagggttcctcatccgaaaattaaaagagcagattctggctaatattgatgtcagaggaaaaatacaagaaatttttggtttaaaactgaaattcagaaatggcagattggcagtgtatttagaaggtacggttttgttttgttttttctaacaggctcaaaggagtaagaaaactttaacaaagacatgggaggtaaaacttctcattttgcgttgcaaagtaaagatgtctgattctaggcagaaagcctgggatctgcctagaccagcttggccagacccaccatattaacttactccattacaatggggaaagagaccacatctcacttgcaacacattaagcaacagtgattgcaaagtagtctttactggagacttcagaggcaactgagaatactatttgtacaaagatacctattatattgtctataaagaacaacattttaaacactaaatggacattcttatacatgtttctttgcacacatgtgtagacatttctggtaaatatagatcagaggaacagctgacttatagggaatatacatctaagctttagcagatattgcccaattgctctccaaaattgtcgtgctagttttcttccccacatcccccaactgcagcagtgtgtgagaggtctctttatttcacttccttatcaacacttggtactaccaagggtctagatatttgacagggtatagctgtgaaatagtaccagcttttaatttgcattaccgtgatcatgtattgatattggaaaccttatgttcattgagtattcagattccttctttcatgaattgcttttttatttgagatttttaatacacttacaattaatatttatatgtggtatgagataaaaatgtactttttacagctggataacctgtagtcccagtgcattttaaaatcattcattctttctcactaatatgtaatgtctttgttaccttatatcaagcttccatatattcatagaacagtttctgggtatcctgttctgtttcattggttttgatatgtaggctcatttgaatgggagtatttgtgcttattttcactttaatatttaattttagttaaattttatatttttaaaaatgaatataacatgcacaatatagtttgttgtggtggtatataatcatcactaataagacaatcaacatataaaacagttccattgaatggaaaaattccttaattattctttcttttactatgtaaataatttttattttcttatcactttacttttaggtagttattacaacattaaaaaatctgatttggaaaagtgttctttttaatcagataaataaaagatgaaattaatttaaatatgtgtgtcagggggtttgtatagttgggacatttaattttgtgattacttgggacaataatttttttttttttttacattttagattcaggtggtacatttgcaggtttcttacatggatatattgtgtgatgctgaggtttgggcttctgttgaacccatcacttaaatagtgagcatagtacccaataggtagtttttcaacccttgcccccatcctactttgccccttctggaatccccagtatctattgtttccatctttgtgccatctctacccatcgtttagctcctacttataaatgagaacatatggtatgtgattttctgtttctgtattaattaggtgctcatctatgatggattggataaagaaaatgtggtacatatacacgtcaaaatactaagcaggcataagctattgaaataataaaaagaaaataagaaaaaataaatgaatgaaatgtgaaaaaagattgatgagaataaaattgcttgctttgttcattaaaaaggaaatcagagatgatacaaataaatggaataatatttcttgctcattggttggaagaatcaatattactgaaatggccatactgcccaaagcaatctacagattcaacactattcctatatcaagctaccaatgtcatttttcacagaacttgaaaaattattctaaaattcatacagaacaacaacaacaacaaaaaaacagtctgaggagccaaagcaattatatgcaaaaagaataaagctggaggcatcacattagcctatttcaaactatactagaaagccacagtaaccaaaacagcatggtactggtacaaaaacagacacatagaccaatggaacagaatggagaccagaaataaagcctcacacctacaaccatctgatcttcaacaaagtggataaaaatgagcaatggggaaaggacaccctattcaataaatggtgctggaataagtggctatccacgtgtagaagaatgaaactggaaactacctatcaccatatagaaaatcaactccagatggattaaagattcaaatataagacgccaaactacaaaaatcctaaaagaaaatctaggaaatacccttctcaacatcagccatggtaaatacatggctaagtcctcaaaagcaattgcaacaaaaataaagattgacaagtgggatctaattaatctaaggtaacttctgcacagaagaaaaaattatcaacagagttaacagacaacctacagaatgagagaaaatatttgtaaattatgcatctgatcaaggtttaatatccatatgctataaggaacttaaataaatcaagaagcaaaaaacaactccattaaaaagtgggcaaataacatggacacttctctaaaggagatatacaaacatccaaaaaacaaatgaaaaaaatgctcaatattgctaatcatcagagaaatgtaaattaaactcacaataagataccatctcacgccagttagaatggctattttttaatatatattttactttaagttctgggatacatgtgcagaacatgcaggtttgttacataggtatacatatgccatggtgttttgctgcacttatcaacccgtcatctaggttttaagccccacatgcgttaggtgtttgtcctaatgctctccccccgttggcccccaccccctgacaggccccagagtgtgatgttcccctccctgtgtccatgtgttctcattgttcaactcccacttatgagtgagaacatgtggtgtttggttttctgttcctgtgttagtttgctgagaatgatagtttccagcttcatccatatccctgcaaaggtcataaactctttcatttttatggctgcatggtattccatgggtatatgtgccacattttctttatccagtctatcattgatgggcatttgggttggttacaagtccttgctattgtaaatagtgctgcacaaacatctgtgtgcatgtgtctttataatagaatgatttataatcctttgggtatatacccagtaatgggattgctgggtcaaatggtaattctggttctagatccttgaggaatcaccacactgtcttccacaatggttgaactaatttacactcccaacaacagtgtaaaagcgttcctattcctccacatcctggccggcatctgttgtttcctgactttttaatgatcgccattctaactggcatgagatggtatttcattgtggtttaaaagtcaaaaagatattgccaatgttgtagagaaaaggcaacacttatacactgttggtgggaatgcaaattaatcagcctctgtggaaagatgtctggaaattcctgaaataactaaaaatagaagtatcattggatccagcaatcccattactggtatatacccaaaggaaaataaataattctaccaaaaagacacatgcaccagtatgttcagtgcagcactattcacaatagaaaagacatggagtcaatgtaggtctccatcaatggtggattggataaagaaaatgtggtacatatacaccacggaatcctacacagtcataaaagaataaaatcatgtcctttgcagcaacatggatgcaaatggaggccatcgtcctaagtgaactaactgagaaacagaaaaccaaatactataagttctcacttacaggtgggagctaaacatagggcatacacagacataaagatgaaaacagtagaccctggggactacaagagaatggggggaggcagtggggaaagggttgaaaaactacctattatggactgttctcactacctgggtgatgagatcaatagtaccccaagcttcagcgtcaccatataccttggtgacaaacctgaacatgtaacccctgaatctaaattattgaaattattcataaaattaccttcaggctatgtttataagctctatataaaacataactgaattttgtgtttagatttgggtcccatccccaaaatatctcattatatatgtgcaaatttttcaaaaatccaaaaatttgaagtgcaaaacacttctgaccccaagcatttcagataagggaaagttaacctgaatggccaccaaatctatcttttgaattagtgtttgcattgcatacattttttattcacttacttttatcatatttatacccttatatttaaagtatgctttttgtacacagaatgtggttggctattttttttttcaatctggcaatctctactttaattggcgtgtttagatcacctacatttaatatatttatttacatgtttgtgcttacattcatcatcttattatttgttttctatttgtcccacatccttatatttatcttttccccctttctgccttcttttggaatatttgaatatttgaattgttttattctaattcatatattgtctttttagaaatatttctttataatatgagattcattggttgctatagggcttacaatcttcacaagattaacttcaaaagtcagcttttgacagtcctaaagtttacatcattccacttccagtaaattgtagtagcctggcaaccaaataggtcagtttaccactcaaatgacctttatgttgcagttatcaattatatcaatattcattaaaaaccacacaagatggctgggcacggtggctcacacttgtaatcccagctttttgggaggctgaggtgggcagatcatgaggtcaggagttcaagaccagcctggccaacatagtgaaaccctgtctctactaaaatgcaaaaaattagccaggcattgtggcaggtgcctgtaatcccagctactcaggaggctgaggcaggagaatcacttgaacccgggatgtggaggttgcagtgagccgagatcgcaccattaaactctagcctgggcaacaagagtgagactctgtctcaaaaagaaaaaagaaacaaaaaaacataggacaaggttgtaatattttatttcaagtcataactattttaaagaatttaaaaagggaaaaaatatttacccagaatttccatttctgttgtatttccttaattcctgattatctaatttccccatgacattatttctcttgagcccaaagaaacttctttggaatttcttataaaatgattttgctggagacaaattatcttagtcctttgaaaatttgagaatgtctttatttttacttctttcctaaacatagttttgctggatataggattctggtattgatggttgttttctttaaacttgttgaagatgctttttcaccatcatatatcctctgtgatttatcttcagtctccaattattgctcccctatatagaatgtgctatttcccaatatcttctttcaagatctttctttactttggtatttagcagtttgattatgatatgtctaggcatgattctctttaatctttctgttttatgttttctgagcatattgattctgtacattgatgtagtctatcagattttggaagtttctgagcgctatttcttcaaaaaaatttttttctgcacgaatctctttctcttctctttttggaactacagtgctctgtatgtgaaaccttatcctattatccaataaggctatttgttccagccatttttcttactgtttctcatattggatgatttctattagcctcccttcaagttcactgactcctttgtcatctctgttctgctattgagatcgcccagataattttttattttggtaattgcattttttatttctaaaatttcaaataggttattttaatattttctaatttctctgctgagaacatctatctttccattcatttcgaacgtgttttcctttacctcatgaaacagagttataatagttgatttaaactctttggctgacacttcaaacatctgggctttcgcagttgacatttgttgattgtcatttcccttgagaattggtgacattttcctttttctttctaagtactaatgctggattttatctagggcattttgaatattttgctgtgtagattctgggctctggagaatgttgattttttttttcatttgttttatcaggtaatcaacttagttaagtttagtttgtgagttctgccttgcgttctgtgggtgatagtctacatctcgttcagttttcaaagactttactaggctatgtttggtttctttcacacatgtaccacttaggagatagtccaagactgtggttttaatctaagttcatagttcaattatcaaagtctgtgctatgcagccttgtatctgtaccatacttgtactactcagggatttttctgaaatttatgtagtggtttaaatatagtgtagttctcaaagctttttctatgctaccttgggtttggcctctgcatgtgcagctcaagagtgaatctattatttgtggggcctcaaacacagaaattagtagaacatcttctttaaccatctccactctggtattcccccacactctctgacctgcagaagcccttttccctctctttgtggtaagaccagtgaggtttctctcagagttttagccacctgtgtcacagtccccctttgtgtctttgcctttggagcaaacctgtaaaagaaaataagaaaaaacaataacatacaggaaatttatttctctgtgggttgcttctccatgttttaactctcttcaaaaattcacctgatcatgtttacttttcagagtctttggtaattacctttgatattttttcagaaatttatttataacaagtgggagagaaagactatagtgcacttaatccatcatgccagaaaccagttcagttttgttttaatttcagtttttaccttctttttcttactatcaagtggttttgtggttgcttctacactgaccctcactccaaattaatagtattttgcagtttattctccgttatgacattgctgatacattcttggtacaacaaaccacttggctcagttccgattcccaggacaatgtctttgtatgccattgtaccttccccctgcttccccgcttatcccaacccagggctgcagccccaaacacaaccataacccacagcctcaaactgagccataccccaggcatcagttcagcttcactttttctaacctcttttcaaggagatccccaggtctgagccacaagcactcaccctgcttccagtcttccctttcatacagagcaattttagtcttttttactttactctttattttcagactcagaattcgggcttcaacattacttactccttttttttgtttctttttcatgatactttgatcttttatttaaaataactatatcttttatattttacctaccattattgtatgtttggaacagaggggttatactgaaatgtaaagttgcctgttccatcttatctggatgttccaaacacttcttaggaacgacagtgtagctacctctggtagtctcttttaatctattatgtccttggaaactataatattttaaatattgaagtcataacaaaatcaactccctttttacaccagttagaatggcgatcattaaaaagtcaggaaacaacaggtgctggagaggatgtggagaaataggaacacttttatactgttggtgggactgtaaactagttcaaccattgtggaagtcagtgtggtgattcctcagggatctagaactagaaataccatttaacccagccatcccattactgggtatatacccaaaggattataaatcatgctgctataaagacacatgcacacgtatgtttattacggcactattcacaatagcaaagacttggaaccaaaccaaatgtccaacaatgatagactggattaagaaaatgtggcacatatacaccatggaacactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggaaggggggagggatagcattaggagatatacctaatgtaaatgacgagttaatgggtgccgcacaccaacatggcacatgtatacatatgtaactaacctgcacgttgtgcacatgtaccctaaaaattaaagtataataaaaaaaacagacaaggaaactgaggcatagttaacttgaagtagagccaggactaacccaacctccacatcctatattagtggtttttctaccaattaattttatgttcaggctaagaatctgtaggccctggaaagatagcagcatatccctgtaatatttaggaatatttcagctgttttgaagattttattattctcctctggctctcagcttgttccagttgaaggacattcctctacagtggaaaggatattgtgcagtgagcctccaagttatgttttggtcatcatttgggcactgcatcaacttctctttctaattttgttataatggtgctccaaggaagtcctactagctcttgggagtgaactctatttgcagcgaggagcaatgaactggtgaagagtctgctctcgaatgttttatttcttccacacttgttactgacatttctttctatgaggctggctatatctacccttttcctcctattatagaatattttttgaaatggaccttaaatatctctgtgctgaaactcttcatgttctagataaagaaactgaagctcagagagtttaaagtcttattcaaggtcataaagcttgtcagtggtactgctagagcttatactgagatgttataaaatcagatgcagtgcttttcccattacattctgggtaagtatcagtataagtaaccaataataagtgtagggaaaaagcaaaaggagagtttggaggaagggaaaatctagaacgagtgaaaggcaaatgaaatcatttgaattgacaattgaaatatgttttggtactttacaatttcagtattaaatgtcaaactgaggaatggaataaagatgaagaaagtggaatgctgagagtgatggcacaagaatcagtgcttttgtagggccagtgaatggagtagaatcctctgaatggtgtctactgtccaacaactatatgtggcctgggactggaacataaattttgagacttcattaagaatgaaacatctgagaattttgggaaacaggcagtgaactttgtccaatcctacctttgtcagagtctagattctagtaaaacaatagtggagttaacaaaaacccacagtggttagggtggtgattgtgatctcttaaatgttttggtagttccttctggtgttattttatcagcatatgttgtgtacactcctccactaaagtcctcaacagaaaagcagctggctggccgggcatggtggctcatgcctgtaatctcagcacttgggaggccaaggcgggtggatcacttgaggtcaggagttcaataccagcctggccaacatggtgaaatcccttatctactaaaaatacaaaaatagtcaggtgtggtggtgggtgcctgtaatcccggctacttgggaggctgaggaaggagattggcttgagcccaggagatggaggttgcagtgagccaagatcatgccactgcattccagcctgggcaactgtgtgagactctgtctcaaaaaaaaaaaaaagagaaagaaaaggaaaagcagctgattatcaaagttttgctgcacattccaggtactagacactagagggaatagcatatgcaagcaaaatgctagaacccaagcctaccaaatgtcaaaagttgtcaggtttgcccaaacagcctgcaaaagtgggcatgagtctattgcagagcctagattggagctcaggacttctgatacaatcttttgtaatttctgcttccgtaagcaacctgtttatgattcttccagagtgtttatctatgattaatgctactgcaaggggaaggggaaattaatgagtacttatagtatcttagtccccaaatattgccaatgacaaatggaaaggtcgttaacgtgagaacaaagcactctagatcttagatgtgcaagagcttgtacataagtcactgttgtccactccttaaatctatgaagctagccaactcagatagctagtcacctgggagctcatttacaggcacccagtccctcttcaagatgaaaagtgtatgcaataatgagcacttattcaccaaaattcccagtgatctggaggtgagaaaacaggaaactcatgactttgttctcttggccaaagcccaaatcctcaaaacctcactatccttagaatggcattgtgaggaactaaagagtctgtcatgacccatagtgagatgtaaaggtgtagttgagttttgttcatatcatttatctcatatgtctaatagaactgtgacaaactctcaccacaaaatgtatttcagagggacagttaacaaatctgacctgagccagaggaaaaaaattaatagggtacagtgagggtgctcaaagccatgtcaaaagaagggagacatttttccattccaagtggccgaataggaacagctccagtctgcagctcccagcgtgattgactcagaagatgggtgatttccgcatttcaaactgaggtaaacgtttcatctcattgggactgtttggacagtgggtgcagcccatggagggtgacccgaaacagggcggagcattgcctcaccgaggatgtgcaaggggtcaagggatttccccttccaagccaagggaagctgtgaaagacactacctggaaaaatgggacactcccgcccaaatactgtgcttttccaacggtcttagcaaacggcagagcaggagattatatcccatgcctggctcagcagatcccatgcccacggagccttgctcactgctagcgcagcagtctgagattgacctgtgaggcaacagcctggcagggggaggggcatctgccattggtgaggcttgagcaggtaaacaaagcagctggggaagcttgaactgggtggagcacaccacagctcagcaaggccagctgcctctgtagtctccacctctaggggcagggcatagctgaacaaaaggcagcagaaacttctgcagacttaaacgtccatctgacagctctgaagagagcagtggttctcccagcacagtgtttgagctcggagaatggacagactgcctcctcaagtgggtcccagacccccgtgtagcctaactaggagacacctcccaataggggccaactgacacctcattacaggcgggtaaccctctggtatgaagcttccagaggaagaatcaggcagcaatattcgctgttctgcaatatttgctgttctgcagcctccactggtgatacccaggcaaacagggtctggagtggacctccagcaaactccaacagacctgcagctgttggagcaaactccaacagacctgcagctgttggagcaaacgccaacagacctgactgttagaaggaaaactaacaaagagaaaggaatagcatcaacatcaacaaaaagaacatccacaccaaaaccccatctgtatgtcaccatcatcaaagaccaaaggtagataaaacaacaaagatggggagaaaccagagcagaaaagctgaaaattctaaaaaccagagtgcctcttctcctccaaaggatcgcagctcctcaccagcaatggaacaaagctggatggagaatgactttgacgagttgacagaagtaggcttcagaagggtggtaataacaaacttctctgagctaaaggaggatgtttgaacccattgcaaggaagacaaaaatcttcaaaaaagattagatgaatggctaactagaataaacagtgtagagaagaacttcagtgacccgatggagctgaaaaccatggcacgagaactatgtgacgcatgcacaagcttcagtagccaattcgatcaagtggaagaaagggtatcggtgattgaagatcaaattaatgaaatcaagtgagaagagaagtttagagaaaaaagagtacaaagaaacaaacggagcctccaagaaatatgggactatgtgaaaagaccaaatctacgtctgattggtgtacctgaaagtgatggggagaatggaaccaagttggaaaacactcttcaggatattatccaggagaacttccccaacctagcaaggtaggccaatgttcaaattcaggaaatacagagaagaccacaaagatactcctcaagaagagcaaccccaagacacataatggtcagattcaccaaggttgaaatgaaggaaaaatgttaagggcagccagagagaaaggtcggattacccacaaagggaagcccatcagactaacagcggatctcttggcagaaactctacaggccagaagagagtaggggccaatattcaacattcttaaagaaaagaattttcaacccagaatgtcatatccagccaaactaagcttcataactgaaggagaaataaaatcctttacagagaggcaaatgctgagagatttttttcaccaccaggcctgccttacaagagctcctgaaggaagcactaaacatggaaaggaacaactggtcccagccactgcaaaaacatgacaaattgtaaagacaattgatgctaggaagaaattgcatcaacgaatgggcaatataatcagctaacatcataatgacaggatcaaattcacacaaactattgtttgttaacaataacagttgttattgttattattgttattattgttgttattgtaatgttaacagttgttaaccttaattgtaaatggactaaacgccccaattaaaagacacagactgacaaattggatagagagtcaagacccatcactgtgctgtattcaggagacccatctcacgtgcagagacacacataggctcaaaataaagggatggagaaagatctaacaagcaagtggaaaacaaaacaaaaaaaagcaggggtttgcaatcctagtctatgataaaacagactttaaaccaacaaagatcaaaagagacaaagaaggccattacataatggtaaagggatccattcaacaagaagagctaagtatcctaaatatatatgcacccaatacaggagcacccagattcataaaggaagtccttagagacctacaaagagacttagactctcacacattaatagtgggagactttaacaccccactgtcaatattagacagatcaacgagacagaaggttaaaaaggatacccaggacttgaactcagctctgcaccaagcagatctaatagacatctacagaactctccaccccaaatcaacagaatatacattcttttcagcaccacatcgcacttattccaaagtcgaccacatagttggaagtaaagcactcctcagcacatgtaaaagaacagaaatcacaacaaactgtctctcagaccacagtgcaatcaagttagaactcaggattaagaaactcactcaaaaccgcacagctacgtggaaactgaacaacctgctcctgaatgactaccgggtaaataacaaaatgatggcagaaataaatatgttctttgacaccaatgagaacaaagacaccacctaccagaatctctgggacacatttaaagcagtgtgtagagggaaatttatatagcactaaatgccctcaagagaaagcaggaaagatctaaaatcaaaaccctagcatcataattaaaagaactagagaagcaacaacaagcaaattcaaaagctatcagaaggcaagaaataattaagatcagagcagaactgaaggagctagagacacaaaaaaaatcctttaaaaaatcagtgaatccaggagctcgatttctgaaaagatcaacaaaattgatagaccgctagcgagactaataaagaagaaacgagagaagaatcaaatagatgcaataaaaaatgataaaggggatatcaccaccgatcccacagaaatacaaacatcaatacaaactacatcagaaatacaaactaccatcagagaatacaataaacacctctatgcaaataaactagaaaatctaaaagaaatgaataaattcctcgacacatacaccctcccaagactaaaccaggaacaagttgaatctctgaatagaccaataacaggctctgaaattgagacaataattaatagcctaccaactaaaaaaaagtccaggaccagacggattcacagccaaattcaccagaggtacaaagaggagctggtaccatctttttgaaactataccaatcaacagaaaaagagggaatcctccctaactcattttatgagggcagcattatcctgatatcaaagcctggcagagacacaacaaaaaaaagagaattttaaaccaatatccctgatgaacattgatgcaaaaatcctcaataaaatactggcaaatcgaatccagcagtaagtacatcaaaaagcttatccgccacgatgaagttggcttcatccctgggatgcaaggctggttcaacatatgcaaatcaataaacataatccatcacataaacagaaccaaagacgaaaaccacatgattatctcaatagatgcagaaaaggccttcgacaagattcaacagcccttcatgctaaaaactctcaatacactaggtattgatggaacgtatctcaaaataataagagctatttatgacaaacccacagccaatatcatactgaatgggcacaaactggaagcattccctttgaaaactggcacaagacagtgatgccctctcccaccactcctattcaacatagtgttgaaagttctggccagggcaatcatgcaagagaaataaataaagggtattcaattaggaaaagaggaagtcaaattgtccctgtttgcagatgacgtgactgtatatttagaagaccccatcatctcagcccaaaatctccttaagatgataagcaacttcagcaaagtctcaggatgcaaaatcaatgtgcaaaaatcacaagtattcctatacaccaataacagacagagagccacatcatgagtgaactcccattcacaattgcttcaaagagaataaaatacctaggaatccaacttacaagagatgtgaaggacctcttcaaggagagctacaaactattgctcaacgaaataaaagaggacacaaacaaatggaagaacattctaccctcatggatgggaagaatcaatattgtgaaaatggccatactgcccaaggtaatttatagattcaatgccatccccatcaagttaccaatgactttcttcacagaattggaaaaaaactactttaaagttcatatggaaccaaaaaagagcccacattgccaagataatcctaagccaaaagaacaaagctggagacgtcatgctacctgacttcaaactatactacaaagctatagtaaccaaaacagcatgttactggtaccaaaacagatatatagaccaatggaacagaacagaggccttagaaataacaccacatatctacaactatctgatctttgacaaacctgacaaaaacaagaaatggggaaaggattccctatttaataaatggtgctgggaaaactggctagccatatgtagaaagttgaaattggatccctcctttaacccttatacaaaaattaattcaagattgaataaagaattaaatgttagacctgaaaccgtaaaagccctaaaagaaaacctaggcaataccattcaggacataggcatgggcaaggacttgatgactaaaacaccaaaagcaatggcaacaaaagccaaaattgacaaatgggatctaattaaactaaagagcttctgcacagcaaaagaaactatcatcagggtgaacaggcaacctacagaatgggagaaaatttttgcaatctacccatctgacaaagggctgatatccagaatctacaaggaacttaaacaaatttacaagaaaaaaacaaacaaccccatcaaaaagtgggtgaaggacatgaacatacacttctcaaaagaagacatttatgcagccaacagacacatgaaaaaatgctcatcatcactggtcatcagagaaatgcaaatcaaaaccacaatggggtaccatcacacaccagttagaatggcgatcattaaaaaggaaagaacagatactggagaggatgtggagaaataggaatacttttacattgttggtgggagggtaaactagttcaatcattgtgaaagacattgtgggattcctcaaggatctagaactggaaataccatttgacctagcgatcccattactgggtatatacccacaggattataaatcatgctactataaagaaacatgcacacatatgtttattgtggcactattcacaatagcagaaacttggaaccaacccaaatgtccaccaatgatagactggattgagaaaatatggcatatatacaccatggaatactatgcagccataaagaaaggatgagttcatgtcctttgcagggacatggatgcagctggaaaccgtcattctgagcaaattattgcaaggacagaaaaccaaacaccacatgttctcactcataggtgattatttaacagtgaaagcacctggacacagggcagggaacatcacatcccagggcctgtcgtggggtggggggcagggggagggatagcattaggagaaatacctaatgtaagtgatgaattaatgggtgcagcaaaccaacatggcacatgtatgcctatgtaacaaacctgcacgttgtgcatatgtatcctagaacttaaagtataatttaaaaaaagaaagaaagaaagataaaatacaaggtgagccaaaggaaaaaaaaaaaagaagggagacataatcaaaataagtcggggcatttagtatggaaagaaacaagaagagcagacaggggtacaaggatcactttctttaaatctctgaagcttttaaatatatatttttttttcttaaagggaagagaaagcagactttgttgtgtggatccaaagggtagcactaagataaatgtgcatgattgtgctggggtggagcagctagaaatggcaaacttacagagactggtttcaagaaaattcaagaattattggacatatatttgaggtaaaaccagaaaatacagtatattatgagcagtatactcaacataaatacagtgatcacttgttgatcggctcatctttattctttcagattagcagcaagcagaagtactgtagggtctggcaaatgagttccctaccaatgggagtcctattgaggtttaagggtgtgtgtaatcatgtgtatgtgtacgttatgcatatatgtgcagaccacttgaggatcatccaagtgcttccaatactgcagtaaatttgcaaaaggaaaaacaattgtgttcaccttttgtttcagaggataatattggaaggaaattaaatccctgaagcaaatgaagaaagagccaagcagcaactgtaaacaattatataaaaagagaagaaaaatcccttcttatcttctactaattaaaatttcatatttgtctctatcaagaattctgtcaacagaggctagactctatatattgtggccctcatgagtttcagtttaattcactggcctttgcacttaattaaatgaaataggaaactcctagtcattccttcacatagaggagctgaagtggtgagtggatactgtcttcagtgtctaggacccaggaccttagacatctgtgtgagttctgcccatttggccttatgggtggctcatgtgatctattctcagaaatagtattaagcagcagcattagctaacatgtactaaactctgaatctgttctaactactggtctaaatactatctccttaaattctcagagcaattctgaagtatcattacctcaattttcccaagaagaaacaggtacaaaggcacacaaaagagcagtggcagaacctaaatccaaacttagtcatgcttttaactactgtatcatattcatcagggttcttctccatgtgttatcaggtgccttgccccaagacagcccgatttcttagccagaaaatggggctagacatcaaggcatagtggtccccgtgtagaacactggagtcatgtcaaatatccctgcttttgcctgggcttggaatagaggcctgtggatggtaacataaattcagagccctctctcacttatgataccaggatgcagtaacaatctcttttccacacctgactgcatgaaggatttctggttgatgcaaatctggtgccattcttatttctaacctgttcactttcattgaaaaggcaaccattgattgttaagaaagaaacagtgtggggaacagcaggaaaataatgttgagaagtttgatctagtagctagctgatctggtacactggacaccaaatcccttcttcctccacttctatcccatttggaaagagtctggcaggtaagaaaattggaatagaggaagtggtgttgaatgaaggaggagaggaaagaaggatggaagaaaaaaaagaaatagaagaaaggtacttagaagaggattggaggaggcaatatagacagaagaccttccttggtcattttagagttgggattgccatcaagccatcctacccattaactcttgagtcccaccataaccattgtattcatccgttcttacgctgctatgaagaaatatccgagactgggtaatttataaagaaaataggtttaattgtctcacagttttgcatggctcgggatacctcaagaaacttacaatcactgtggaaggcacctcttcacagggcaacaggagagagaatgagtgccagcaggggaaatgccagacacttataaaaccatcaaatctcatgaaattcactcattatcatgagaacagcatggggaaaaccgcccccatgatttaattaccaccacctggtcccgccttgacacatgggaattatggggattacaattcaaggtgagatttggatggggacacaaagccaaatcatattacctataaattttatagacttttccctactatctctcttcttatctgtaggatgttggaagtctgcatgactatcttacaattttacaaccatgttgatttagaaagttattctgtatctgcaatgtttttgcctaaaatattggattcaaatataatggtggtctcttccattaatgaatttattttgttttatgtatttggggataggacaattggaggtcattatgtcacacagtaggtatataggcatttgcttctttagccaatgagcctggcaatgtgtctgaagggagaaaccttaagggagcatattctgggttctgaagttttgtctcttctccttcaagtaccgaaatagctccaaagaatcctctgctctagatgagagcccagctatttaaaacacagctctagtttcagagacatgttatttgctgattaagtttgggagtaaattgtgtattttggtgaactgattatagtgttgattattattaaatgatactcatagtctcttctcaaaatgggaatttttatggatgagtgtagtggccttgagtatattgaacacataaatgcctgagtaggggcacaatatattaagcctaaggaatggttctggaaagtgagaaatcaacgagagctaaaatacatttgggccaaaactcaggtctggatgagtacagctaatatggtacagatggagtagatgtgttccctacctttccgtgagagaaaagaaatagcaccataaactgcagtagccagctctattatagacatacatcaaggcttgtgtaggctttactcctgttagctgtgttactagtgtgctcaattcaggtcagctatgctgggctggagtgagacttgtttggtttactgtaatcttgaggtgtctggtaggctgaaatgggctttgcaaggctgggatagcctgccttagctcatgctccatttgaggtacgctggaatgggtaggctaactgggctgcagtgggggtaagtagggctgacagaagcaggaaaagaaaaactcagtagtggaaaaacttcacttctctgggtagctgctgttctggatgtatatatacttatataacttatatactatactatacttatagtatataagtatataacttatatactatactatacttatagtatataagtatataacttatttataagtatatttataactaacttataagtatataacttatttatatactataaacttcacttctctgggtagctgctgttctggatgtttttgtctccccacaatctgtatgctgaaatttatagtactaagtactataaatacttagtactaagtactatatagtatataagtactatatagtacttaatactatagtattaagatagtactaagcagtgaggcctttagaaggcgattaggtcaggagggctccaccctcatgattgggattagtgctcttataaaagaagcttgagcaagctccctagccccttccatcatgtgaggacatagaaggcaccatctatgaggagtggaccctcaccagacactgaacctgctggtgccttgatctaagacttcccagactccagaactgtgagcaatgaatttatgttctttataaattacccagtctaaggtattttgttgtaacagcctgaatggactaagacagtattaatttccaatttggcaaatatgtggtgtgtgatgagattaatccattcatgcaaaacttgatgtttagtgagcaccatctgagtcataaacctttcagaagctcttgggttaggtgggaagattgacaagtaaaacaaatggttacaatgaaggaaagtaaatgtaaagagtgtatcaaatgatatcagttgtctccaaatatgggacaattaacccccccaaaaattatttctcattcatgcaaagtctattgtggatccaggcaactctccagggcagtgctcctccatatattagctcatcattccagactttttcaattttattgtagcaccacagcaatgtgtgtttttacgatcatcatggcatggagggtcttgcattagacatcaattgttccagccatgagagacacatattactttctcccacatccagaaccattcctattgcccctctatattttaaaaaggcaggggagtggaagaacaatcatcctatgttcctagaagtggaagagtgttggatattgcaacatttgtaacctactacaggtaagggtaagcccagtgagagctcagctcttgtgaatgtcagggatctctaagggccctatctaagctttgttgttttggtattatgctgtcattttcaatgatactaaagggatagactttgagtctgtacctagcatgttccctgtgaagagatagcacagatgagaagtttttgaggggttttcctttctcagaagtagtaagttggctgtcattcagagtactgcactggactctctctgagctaagacaaaagcctttcctgacattctgcttttctactttctttcacgcagatgcagtgactgaagtgaagactgacatctacgtgaccagttttggccctgtgtcagacactgacatggtaagttcttgcaaaggtaaatgtaaaagaggatgcactagaccaaagaaaataaattggagctttcctaaggcagggccttgtagctatattctaaggagtggtcttttctcatatgaatttcctaccctcgccaccctacgtttagccaaatccatctttgccctgctctccccacctattcacatataatgtatatacccctttcaggagtgcccttatctttctcccacgacacatctttcaaaagtttgtttggttccctatccttaattaaagcttccctgacttctcccttcacactctgctggcaccacacatattggtacaggtaggtcatatgaggagagaattgtggtggggattctcagtaaagcagctggtggtgtcatccaagaagtctgttccttgtaactgggtttcatccactagggacatggactggccagaatgatacaaacagtttggagaaagaatctaaatcacttctggaaactattctttgtacagatttgggcatggagagagcttcattgcagactcaaaatatagagcagggcacagcagaacaagcaagggagtggccccttttctcaccattatccattgtattcaaaacaaagagtacagtggagagttgaagcagaaggcctcactcaaatagataccctatcgatatatactgagtatcaaatattcaattgaataattatgatttagagacacaaaaaagctattatctgctttgtatacctggccattattagatgttcaataagtttttgttgaatgactgactttgtgttgcaagcaaaaatcctagtatcagggaaaatatgtttgaagataatgacatgcccatgttcactatttagagtttttttctgtgtgtctattttcagtgggactactacttggcaggggacaaagcttctttccgcctgttggactaacacaaacagttgtgtagggaagtggtagaggttttcttataggtaatgcagagccattgggtggattttgttaggacagtaaaaatatatgtgttgttttggaatgattgatctggtgatctgtgcaggatggagtacaaaggggaaaaggctggagcctgagagttgatttaggcccgttgattttacatgactcttcaatcaggtgcaaggtctatgagtcaattggaaaagctggctagttctcaggagaagaaatcatcagtatgtgaatgtttggaaggccaggcatgggtaaaggagaggtctgaaccttgtctttcaagtgtagagtaaagagaagggtacattagacttcctttgaactcctcgagggcaagtaccaagtctccatggcttccctggcacttaacagcatttgacacacagggagagctcattaaggggtatgtaagatataaggaatggaggagatggttctctcttagggacagcaagaaagcctgtatgtctccattgccctctgtcaacttgttgactagtaattcccacaggcatgtgttaaaatccaggcatgtgttaacattgttgccagttggccattcaacaagtactccttacgagcccaactatgcattaaaggctctaggaagccctatattcagagatctcacagcccatcagagacaaccatactcaccaggtgtatgtagctctttttctattgttaggaattaaattaggatatttataaaaggataaatgaagtgactcttctcacacacacatacactcactcactcattttcattcatgcaccaacaaccataaataacattcagacaaatatacatacacataacaaatacatatagggtacacagcccacacactattctaggcattctgtagaaacacatatgcaaacagatacctaaacccaggcataccagagaaggacacacacagtccctgttccaaccagctcctcactctgctgcttcctcaccatagcaggcgtgtatgggtgtgtccaggctctggagacgtttctaacaattgggactttctgtctatgtctcttgaagtttcatgttataatttgcttgtttgtttttattcctcattatttagctgaagcaacagaatggcaccttcctgatagagagggcagactttggtcaaatgaatttcacattatttttagccgcatgtccatccagtcacaaggcagaatagctacaatcattctggctaaaaagcatatttcgggtgttttgagaaatgtttttttttctgtgctactaagtagactgttcaattgatcccagggccagggatgcatttgggtaaagctttaggcagtcttctgactttggcaactagtttcaccaagaacccaggctcccctgagaccacagactacttggaaaagttgatgaaaatttgggctgcctgggttcttggctcatttccaggaaaagagggcgtttgggtccaaaatactttcctaaggaaatagaggcagtcttttgttcacaaagggggaaaattacgctgccactttgaacattgacacaccaccacccataatattttacatccattacgttccttggccaaacactggcccttacagacacagcttctcagcttttttgacaaaagctccatgaaggtataagccatgtctgttttgttcatctcaataccataaatgtctgactcagtgtttggtacatggcaaactcccaactttttattaagtgcaagaataaatgagaaggaacaaatcaaatctgagggaaaaataatgactgtcttcctccacttagctgaaaaattttcaaggacagaaaacatgtcagggacatctctggttctccagcatttagcacagaacctgacagaggtcctctgtatgtgtttgttgagatgaaattaaacattaatagcaagccctgcagataaagagtgaaaatagctttcctcaggagacattagtgattattaagactggtgactcaatgattgatgattccaagcttcagctactaggtttggtggcttctccattcatgaatataaggaactatgacagtagggaactgagcaaagatgaaagctaaacagtggtagatgtttctaaggagaaagtcagagggaaaaaaaagaaatttaatttagagtacaagagataagttggaaaatggttgccctggcagtttcacaggcttgtggtgaggctggtgttattcatttgcaacaaattgagcttgctggtcacacaaagcatcatagctcctcagtagtaatgccaatcctgtgtccatgatctcctaggagagaaacagaacaaagaagactatcccaatttgagtgaactggggccatgcaaccttctataattatctattattaggagagtttagaccattttctccatcagatgtataggaagagggtggaaatggcaataagagaaaggttgcaaagaattagaatgcagagacagtgggcaagtggcttaggaatatcattctaggcatattgtcagtcactggaaaggaaagcagaaaagtaacagctgagaaaaacattggctgctcttctatctggtccaaattcccttctgacctagcttccatcctagctctcaagatcctaaggctccaggcactgctccaccttctcttctagtccctgagcatgtcagaggtgcaggaacccagggtcccatggtatgtaattaacaagtatttgtctgaactataccaagaaaactaatgagaaaataaagagggaaaagaggagtaatgttaggagagtcagggagataataactgggaaacttaaaatgccaattttaggtattattaacctcaccctctccccaggaatactttgcttagatcccactaggtgccagctagtgccactagtgtcagctgccacagagaaatttcctaggatatacagtggacaatcaggtaatggtgcaagtatacaatacaatgaaagaactaaccatctagcttaatgagaaaaacaaaatggaatcctgggaaataagaacacagaaaaagacattatagtaataattctagacaacagattcagataacgtacattctgatatgacaactgcttatgaaaattatgccattatcctagtatccaaacaccatggagaaaaaaaaattgtgttaattaaaaggagaatagcacagggatctctttcctggtggcagtagaattgaaattattgtacctgttttctctctagtgctagaaaaagtagctatgtctacttcaaactctcccttactggcagtctgaggcacagactggatgagaacctttgtctattttaggctgtcaatttattcttattccacaggatatggcattgcagatgcaatatagaaaggaatctatgtccttgagctttttctaggagtctatgaccaggaatctccttggatatttttacgtaacatagagagccaggaaatataaacaatgccaataagagagggatgccctctctcaccactcctgttcaacatagtgttggaagttctggccagggcaatcaggcaggagaaggaaataaatggtattcaattaggaaaagaggaagtcaaattgtctctgtttgcagatgacatgcttgtatatctagaaaaccccatcatctcagcccaaaatctccttaagctgataagcaacttcagcaaagtctcaggatacaaaatcaatgtgcaaaaatcacaagcatccttatacaccaataacagacaaacagagagccaaatcatgagtgagctcccattcacaattgcttcaaagagaataaaatacctaggaatccaacttgcaagggatgtgaaggacctcttcaaggagaactacaaaccacttctcaatgaaataaaagaggatacaaacaaatgtaagaacattccatgcacatgggtaggaagaatcaatatcgtgaaaatggccatactgcccaaggtaatttatagattcattgccatccccatcaagctaccagtgattttcttcacagaattggaaaaaactactttaaatttcatatggaaccaaaaaaaagcccgcattgccaagtcaatcctaagccaaaagaacaaagctggaggcatcacactacctgacttcaagctatactacaaagctacagtaaccaaaacagcatggtactggtaccaaaacagagatatagaccaatggaacagaacagagcccttagaaataatgccacatatctacaactatctgatctttgacaaacctgacaaaaacaagaaatggggaaaggattccctatttaataaatggtgctgggaaaactggctagccatatggagaaagctgaaactggatcccttccttacaccttagacaaaaatcaattcaagatggattaaagacttaaatgttagacctaaaaccataaaaaccctagaagaaaacctaggcaataccattcaggacataggcatgggcaaagacttcatatctaaaacaccaaaagcaatggcaacaaaagccaaaattgacaaatgggatctaattaaactaaagagcttctgcacagctaaagaaactaccatcagagtgaacaggcaacctacagaatgggagaaaatttttgaaatctactcatctgacaaagggctaatatccagaatctacaaagaactcaaacaaatttacaagaaaaaaacaaacaaccccatcaacaagtgggcgaaggatatgaacagacacttctcaaaagaagacatttatgcagccaaaagacacatgaaaaaatgctcatcatcagtggcaatcagagaaatggaaatcaaaaccacaatgagataccatctcacaccagttagaatggcaatcattaaaaagtcaggaaacaacaggtactggagaggatgtggagaaataggaacacttttacactgttggtgagagtgtaaactagttcaactattgcggaagtcagtgtggcaattcctcagggatctagaactagaaataccatttgacccagccctcccattactgggtatatacccaaaggaatatacatcatactgctataaagacacatgcacatgtatgtttattgtggcactattcacaatagcgaagacttggaaccaagccaaatgtccatcaatgatagactggattaagaaaatatggcacatatacagcatggaatactatgcagccataaaaactgatgagttcatgtcctttgtagggacatggatgaagctggaaaccatcattctcagcaaactattgcaaggacaaaaaaccaaacaccacatgttctcactcataggtgggaattgaacaatgagaacacatggacacaggaaggggaacatcacacactggggcctgttgtggggtggggggaagaaggaaggatagcattaggagatatacctaatgttaaatgacaagttagtggttgcagcacaccaacatggcacatgtatacatatgtaacaaacctgcacattgtgcacatgtaccctaaaactttaatttaaaaaaaagactatttcatggactaaatacatctgaaataacgtatcaattatgtttcttcaaaatagagaatgatgaagagaaggcgaagagtagaggaaagatgggatggccaaaataagagggagtggcccttgtaatgggaaaatggcaaggccttcattgtaatgcagttatcacgtgccttggccccatacactgctaaagctgaataaactttgcaggctttatctgggagcctgctttgacacatcgaacagtgttagagagttgaagccattcaagctctaacaagacagaaatgcttccccaagaactaagtgtcatctctgccctgtgtagaaaatgtattaagcgtctttcccaggaggcagactcaggcttattatctggaagatgtgatttaaatgcctcacaaaacaacagaattcatttgtcaatttctaggcagtcatccttggagcgtatacaagggatcaatttgcaaggaaggaattgattacatttctagaatggttaggtcaaaatctgattgcttttggccaaaggtcatggaatacttgtggagcaaataatcactttgtgattttccccagtagttttgactgtgtagagaaaatttcctatggtatacagtggataatcaggggggaaaatggtgcaagtatacaatacaataaaagaactgaccatccagcttaatgagaaaaataaaatggaagcctgggaaataacacagaaaaagacattatagtaataattctagataacagattcagataacatacattctgatatggcaactgcttatgaaaattatgccattatcctagtatccaaacaccatgcagaaaaaaaaaactgttaattaaaaggagagtagcacagggatctctttcctggtggcaatagacttgaaattattgtacctgttttctctctagtactagaaaaagtagctatgtctacttcaagctcccgcttattggcagtctgaggcacagactggatgaaaacctttttctattttaggctgtcaatttctctgtgtagagaaaaaatagatatgatcatccaactttttaaaatcttaaaaatgagtcaaatgtctttttatggcatattatctaaaaaataatatttaaagatacaagcaaaattacctgtgtaccttaccctgataccatttccctgtttccctccctcctcaaagatattcacaaccgtgaagttgcttttgtctttttgtcatttatatgcatactttataaataagaatgtgtatatcacatacattcataaataacaaatagtggcttttgtgttttgaaacttttatataaaactcatccatagcatgtgtatcattatacaacttattttttaccacgtattaaaaactctacttttttgtgtattttactctaattcatttattttaactatcaaagattattacattgtatgaatatgtggtcatacattcatccattctcttgttaatgtgcatttgggctgtttccttttttggctattaaaaagcagtaatacaacaaacattcttgtacacatatttttgtgaacattttttaatttctttagggtgtgtacctaaagataaaatttgtggtttgttagggcttgcacatttttaacttttttcagtttagggccaaatactcttgtgatgaatcatatcaatgtataatctcaatagcagtgtatgagagctcaatttctctgcacttttgctaatgcttcgtattgtcatactttatttttgacactgtgatgggtataacatggtatctaatttattttgtttgcatttttctgattacctttggtgtttaagcatctttttatatgtttagtggtcaatctgtacatactaaagacaagatggctttgccaccacctgcatcagcaaaagtataaactctaggcaaccttgtttcttcatattgccacttttgtattaaagtttcctgtgggctgtgtgtgtgtgtgtgtttaataatgaatgtatttgaaattttgtaactcttcctttggcctgtattaagatgattgcatgaattttctcctctaatatgttaatgttattaattacatcaatagatttcctaatattagaccatcttttcattccttaaaaaaatcggattttacagggaggtattcctttttatacatgttttagttaggtttactattattttattattagtatttgtatgtgtgttcataagtattcccaaattaactgtctctcattcatatctagccatctatatctatcctataaatatatatataaatgatttatttacaggatataaatatatttatttatttatttattttgagatggaatctcactctgttgtccaggccggagtgcagttgcacgatctcgactcactgcaacttctgcctcccaggttcaagcgattctcctgcctcagcctccccagtagctaggattacaggcacgcgccaccacacctggctaatttttgtatttttagtagagacagggtttcaccatgttggccaggctggctcatctcgaactcctgatcttgtgatctgcctgccttggcctcccaaagtgctgggattacaggcatgagccaccacagccagctctatttatttgatatttaaaataaatatgtaaatatatattttatatttaaaataaatatgtaaatatatattttacatttaaaataaatatgtaaatatatattttatatttaaaatatatatttattatatataatattaaatatatattatatattatatatatttatatataatattaaattatatataatttatatatataatttatatatattttattatatataataaaatatatataaattatatatatataatattatatatataaattatatatataatattaaatatatataaattatatatataatattaaatatatatattatattatatatatttaatgtttaaattaaataatatatgatacatgtatacatttattatatatatgaatatatttctataaatatattcatatcctataaataaatatatatgtaaaacatatgccacacacacaccccaaagtagaaaaaaatagtgtaattgggctccatgtacccatattcttacccctacccataacaattctccctgtctcgttttctcaattaaacttatcaaaatttttgatatcattagtgttttcaaagtaacctttttttgttttgttcatcatctgtattatttatttttgttttctgtttcactgatttgtgctcttatctggatcatctctttctttactttccttggggtattctgtggtccttttggtttcctgaggtatattaacttattggttttccttttccttaaaggctatctttaagccatctttatgaatatcaatttccctccaagcaccactttaagagccccaaacaagatttcatatgtaaacattttcactattgttcacttctaaagattttcaaataatctttaaggtttcttttttgtttcttgaaatttttttagtgtttttcaatttccaactataaaactttttgttattgattcttaatttaatgcctcatattgaaagagaatgatctgtaggatgtaaaacctttttgtgtttcttgagatttgtcctatgtcttagcacgtggtcatttttttttgtcgggggtggggtgggaagtaaatatgctgtgtgtgttttactaagtgttaagtagataagtttatgagtgtttattagctcatccttaccaactgggttgttctaattttttaaacttacaaattattggtctgattggtctttcacttatcgtgagtctaaaggtttgttgatttttccttgtaattcaattttttgcagtagatattttgagtacctgttattgaaacatacaaagttagagttgttactttttccactcaagatactccatctgttagtgtaatgatattttatctcaaagaggatttttaatatgcccttttgtctgtactttacagctctacctttatgattttcctacacatatttgtccatcacagtactttcaaaccttctgtgtttttatgtcttcagatgtgtctcttgtatgtacatagcatatagccacattgtgtttccttcagtaatatttatttatctattttacttatagaggtaaaataatacatatacactttaccatctttaccattttgagtgtacagttcagtggtaataaatatcttttgttcttttttgtcctgtaatctgtcctccctactacccttcccctgctctactaatcatcattctattctctatcttcattagctcaaactttttagctcctacatgtaagtgagaatatgcaatatttgtctttctgtgattaccttattttacataacgtaatgacctccagttccatccaagtttctgcaaatggcaggatttcattatacttaaggctgaatagtatttcattacatatacataccgtattttctttatgcattcatccattggtgggcacttaggtcaatgccatattttggctattgtgaatagtgctgcaatcaacatgggaggacaggtagctcttggacatattgatttcctttctttttgatatgtacccagtagtggatttgcaggatcatatggtagttctatctttaatattttgaggaatctccatactgttctccatagtgtttatactaatttacatttccaccaacagtgtataagctttcccttttatcgcatccttgcaagcatctgtaattgcctgtctttcagatagaagccattttcactgagatgaggtgctatctcgttgtggttttgttttgcatttccttgatgattagtgatgttgagcgtttttcatacacctgttgggcatttgtatgtcttctttagaaaaatgtctattcagatcttttgcccattttaaaacaggattatttatttatttatattttctattgagttgtttgagcggcttatatcttctggttgttaatcccttgtcagatggtgtgttagtccattctcctgctgctataaagaactgcccaagattgggtaacttataaagcaaaaagttttaattgactcacagttccgcatgactggggaagcctcaggaaacttaaatcaaagcagaagggaaagcaagcacatcccccttcacatggttgcagggacagcagtgctaagcaaagggggaaaatccccttataaaaccatcaaatctcatgagaactcactcactatcatgagaacagcatgaggatacctgccccctgattcaatttcctcccaccagttccctcccaccacacgtggggattatggaaactacaattcaaaatgagattcggatggagacacagccataccatatcatttcacccctggcccttcccaaatcttatgtcctcacatttcaaaacataatcatgcctttccaacagtcccccaaattattaactcattccagcattaactcaaaagtccaaatccagagtctcatctgagacaaggcaagtcctttccacctacgagcctgtaaaattgaaagcaagttagttactttctagatacaatgggggtacaggcgctggataaatacatccattccaaaggggagaaattggccaaattggcaacaggccccatgcgtgtccaaaatccaatagggcagtcattaaatcttcaagttccaaaatgatctcctttgaattcatgtctcacatctaggtcatgccgatgcaagaggtgggctcccacagccttgggcatctccacccttatggctttgcagggtacagtccccctcccagctgctttcacaggctggcatcgagtgcctgcagcttttccacgtgcatgatgtaagctgtccatggatctaccattctggggtctgcaggatgctggctctcttctcacagctccactaggcagtgccccagtggggacctgtgtgtgggatccaactcgatcattcccctttcacactgccctaacacaggttctccatgagggctctacccctgcagcaaacttctgcctggacatccaggagtttccatatatcctctgaaatctagacagaggttcccaaacctcaattattgacttctgtgcacctgtaggctcaacatcacatggaaactgccaaggcttgggggctgcaccctccaaagcaatggcccgagctatacattggccctttttagacacagctggagtggctgggatgcaggacaccaagtcctgagactgcatacagcagaggggccctggacctggtccaggaaaccatttttccctcataggcctctgggcctgtgatgggaggggctgccataaaggtctctgatatgccccggaaatattttccccattgtcttggcaattagcattcaattcctcattacttacacaaatttctgcagccagcttgaatttctccccagaaaatgggtttttcttttctatcacattttcaggctgaacgttttccaatcttctatactctgcttcctcttgaacactttgctgcttagaaatttcttctgccagatacactaaatcatctttctcaagttcaaagttccacagatctctagggcaggggcaaaatgccaccagtctctttgctaaagcatagcaagaattatctttattccagttccccccaagtttctcaaccccatctgagaccatatcagtctggactttattgtccatatcatcatcagcattttggtccaagccattcaagaagtctctaggaggccaggtgcattggctcatgcctgtaatcccagcactttgggaggcctaggcgggtggatcacctgaggtcaggagttctagaccagcttggccaacatggtgcaaacctgtctctactaaaaatgcaataattagccaggcatggtagcaggtgcctgtaatctcagctactcttgggggccgaggcaggagaatcgcttgaacccgggaggcagagattgcagtgagctgagtttgcaccattgcagtccagcctgggggacaaaagcgaggctttctctcaaaaaaaaaaaaaagaagtctctaggaagatccaaacattcccacatgttcctgtcttctcaggcctccaagtctccaggaagttccaaagtttcccaaattttcctgtcttttttttttttttaagttggaatctcactctgtcacccaggctgaagtgtagtgatgcgttcttggctcactgcaacctctgcctcctgggttcaagtgattctcctacctcagcctcccaagtagctgggatgacaggcatatgccaccgtgcctggctaatttttgtatttttagtagagacggggtttcaccacgttggccaggctggtcttgaactcctgacctcaagtgatccactggccttggcctcccaaagtgctgggattacaggtgtgagccactgcacttggcctttctgacttcttctgagccctccaagctgttccaccttctgcctgttatccagtcccgaagttgcttccagattttcaggtatacttacagcagcaccctagtacctcctggtactaaggtactgtattagtccgttctcacactgccataaagaactgcctaagactgtaatttataaaggaaagaggtttaattgactcacagttcagcatggctggggaggcctcaggaaacgtacagtaatggcagatggggaagcaaacacgtccttcttcacatgctggcagaagagagaagtgtcaagtaaagggggggaaagcctcttataaaaccatcagatctcactcactcactatgacaagaacagcatgagggtaactgccactgtaattcaattacctcccacgacacatggggattatgggaaatacatttcaagatgagatttgggtgggtacacagccaaaccatatcgtatggatattttgcaaatatttcctcctgttctgtgggttgtctcttcactttgtgaagattgtttcattttctttgcagaagcttttgaacttgatgtaatccacttgtcaatttttactttggttgtccatgcttttgagtcttatataaaacatctgtacccaggccagtatcatggagcatttccgcaatgttttcttccagtagtttcataattttaagtcttaaatttaagtcttcaatccattttgattttattattgtgtgtgatgagagataggggacgagtttatttcttccacatatgggttattctgttttcccagcactatttactaatgagactttccttcccctgttgtatgttcttgctgcctttgttggagaggaattttctgtaaatgtgtggatttatatctgggttctccattctgttccattagtctatgtatctctgtttatgccagcaccatgatgtggtgtttttttagtattgctttacagtaagttttgaagtcagatactgtgatgcctcaggctttgttctttttgctcaggattgctttggttattcaaggccttttgttattctacataaattttaggattcgtcttttctttttctgtggagaatgtcattggtatttttggtagggattgcattgatttgtaagttgctttgtgtaatattgtcattttaacaatatcaattctgtcaatcaatgagtgtggtatatctttccattttttgtgccccttcaattcctttcatcagtttttaaatttccttgtattgatctttctatttttgagttagattgatttttaggtattttgcattttttgcagttattgtaaatgggattgccttcttgatttgtctgacattggcatatataaatgttactgtttttgaatgttgatttcatatcctgcaactttatggaattcatttatcagtactaacaattttttgttggagtctttaggtatttctaggtataagatcatattatctgcaaatgatgctccataggcaacaaaacaagtctgaacaatttcaaggaaatagaatttatatcatgtatcttttctgtccacaatggaataaaactagaaatcagaaacaagatgaacattttaagctacacaaacacatggaaattaaagaacatgttcctgaatgaccaataagccaatgaaaaaattaagtagtaaatttaagaccaggcacagtggctcatgcctgcaatctcagcactttgggtggtccaggcacaccgatcccttgagctcaggagttcaagaccagcctgggcaacatcacaaaacctcatctctacacaaaaagtacaaaaattagccaggtgtggtgacatgcacttatagtctcagctacttgggaggctgaggtgggaggatcacttgagcccagaagattgaggctgcagtgagccatgttcatgccactgcattccagcctgggtgacaaagtgaaaccccatctcaaagcaaagtgtattagtccattcttatgctgctaataaagacatacccaggaatgggtaatttataaaggaaagaggtttaatggactcacagttacacatggctaggaggcctcataatcctggtggtagacaaaggaagagcaaagggacatcttacatggtggcagggaagagggcatgtgcaggggcactcccctttataaaaccatcttatctcatgaaacttattcactatcaggagaacagcatgggaaaaacccacccccatgattcaattaccttctaccgggtccctcccatgacatggaattattacaattgaaggtgagatttgggtggggacacagagcaaaaccttatcacaaagcaaatttgaaaatgtactgaaacaacaaaagtggaaatacaacataaaaaaaatctgtgggatacagtaaaagcagtactaagagtaaagtttacagcaatagacacttaagtgaaaaaaatagaaagacactccaaaaaaaacctaatgatgcacttcaaaaactaaaaaaaagtaagaacaaatcaaaccccaaattagtaggtgtaatagtaaagatcagtgcaaaaataaatgaaattaaaacaaaatatacagaagatcaatgaaaaaacttgtttttttgaaaagataaaatcaacaaacctgtagctacactaagagaaagagagaagacccaaataaaatcagaaatgaaaaaggaagcacaagtgagatctcagaaataaaaagaataattccaaactattataaacaattatacaccaataaattggaaaaactagaagaaatggatacattccttgacacatacagcttactaagactaaaccatgaagaaagagaaaaccccaataaaccaataatgagtgatgagatagaagctataataaaatttctcctgtcaaataaaacccaggacctgatggctgcattgcttaattccagcaaacatttaaaaaattaataataccaattcactcaaactcttcaaaaacttaaagagatgggaatatgtccaaactcattccacaaggccaatgttaccccaatgctaaaaccatacaaggccacaaaaaaagaaaactagaagccaatatcactgatgaacctagatacaaaaatcctcaacaaaatactagcaaagcaaatacaacaatacattaaaaagtttattcaccataatcaagtaagattcatcccaggaatgcaagaatggttcaacatatacaaattaataaatgtgatgcatcacattaagggtgtcaagaacaaaaacccatgtgattattttaatagataccaaaaaagaatttgataaaatccaacatccatttatgatgaaagccctcaacaaaatggacatagaaggaacataactcaaaataataaagctcgtatatgacaaacccacagttaacattgtgttaaacagtgaaaaaattgaattaatgtagttatttgttccactttgtttttacagctcttattgtcatttgtagatattcatatttgtttaggataactgtgtcaatacttatgctcaccattcctttttgcatctttctgctggctatatttttaaacacatgaagatcttcttttagtagttcttttcatgataattcattcaatcatctactgatttaaaattcttatagagcatctgctatacgctatgcagagttttatgtggtgtagatatagcagtaaacaaaacaaagtccctgctgtcatggagcttccaggctagtggaagctggctagtgcagtgtaaacaaataaaaaaatatttttttttcagtgctataaggaagaaaaataactcatggtaagaggaagggagattactattaatgataggatgttcaagcaatgcttcggatacagtaacttttgattaaaacctgaaggctgtgagtgattcagccatgagaaaacctggagcaacagtgaagatctgttcatggtaaattctctgccttattttacttatctaaaattatctttattttgacttcactcttaaatggtaatctaagtttggctatagaattctgaggtgatcgttacttttctgtcaacattttcttcccaggtttgtgggtttttatgatgaagggatgttgaattttatcaaatgctttttcagcatcaattgaaatgatcatatggtttttgtctttcattctatagatatgctgtatcgcattgactgaattgcatatgttgaacaatccttgaatcccagggataaatcccacttggacatgatgagtgatctttttaatgtgttgttgaatttggtttgctagtattttcttgaaaatctttgcatcaatattcatcagatatattgtcttgtagtttttttatgtgtctttgtctagttttggtatgaaggtaatgctggccttgtagaatgctcttgatataggattcccttctcctctattttttgaaatagtttgagtaggattggtattagttcttctttaaatgtttggtagaattcatcagtgaagccatcaggtcccaggcttttctttactaggagtctttttattatggctttgatcacattacctgttattggtctgttcaggtttggatttcttcatggttcaatcttggtaggtttgtatgtgtcttagaatttctcaatttcttctagattttccaatttattggcaaatagttgctctcagtagccaataatgatcctttgaatttcttccttatcagttttaatgtctcctttttcatctctgattttatttcattattctctcttttcttcttagtctggctaaaggtttatcaagtttatcttttcacaaacctactgtttttcattgatcttttgtgctgttttatttattaaagtttcatttatttctgctctgatctttattatttcttttcttctactaatgttgggcttggtttgctcttgttttttctagttctttaagatgcattgttaggttgtttatttgaagtttttcttcctttttggtagaggcacttatatctataaacttccctcttagcactgctttcactgcatgccataggttttggtatgttgtgtttgcattatcatttgtttcaaggaatttttcaatttctctcttaattccttcaatgacccattggtcattcagcagtatgttgtttaatttccatgtgtttgtgtagtttccaaaattcctcttattattgatttctggtttttttccattgtggttagagaataggcttgatattatttcaaatttttttaatgttttaaggcttgttttgcagcctaacatagggtctatccttaagaatgtcccatgtgctgaggaaaaaaatgtgtattctgcaaccattggaggaaaagatctgtaaatatctattaggtccatttgatctatactgcagattaagtccaatgtttatgtgatgattgtctgtctggactatctgtccaatgttgaaatgagttattgaattctccagccatcattgcatagggctccatctctctctttaactctaataatatttgctatatatttctgggtgctccagcattgggtgcatatatatttacaattgttatttcctattgctgaattgaaccctttatcattatatagtgaccttctttgtatcttcttatagtttttttcttgatatctattttgtctgatataagtgtagctactcctgctcttttttgctttccatctgcatggaatatctttttccatccctttattttcagtttacatgtgtctttaaaggtgaggtgtgtttcttttaggcaacagaccactggctcttgcttttttcatccattcacccactgtattttttttattatagcatttagtcaatatacattcagcattattagtagtaagcaaggacttacttctgccattttgttatttgttttctagttgttttgtggtcttttcttccttttttcttcccttcttgtgattgttttactgaaggtgattttctctgatgatatgatttagtttcttactttttactttttaagtatccattgtatggtttttggtttaagtttaccaggaggtttgcaaatactatcttatgccccgttatttaagctgatgacaacttagtattgttcccataaacaaacaaacaagcaaaaagaaaactaataaaaattctataccttatttgttcccccactttttaactttttgttgtttctatttatatcttattctactgtctatgtcttggaaagttgttgtagttattatttttgattagtacatgattgaatctttctatgaagataagagtagtttacacagcacagctgcaatgttatagtattctgtgtttttctgtgtacttagtaacaccagggagttttgtaccttcagattatttcttattactcattaatgttcttttctttctgattgaagtactccccttagcatttcctatagggcaggtctggttgtgatgaaatccctccgcttttgtttttctgggaaattatttatttctttttcatgtttgaaggatattttcaatagatttactattctagggtaaaagtttttttacttcagtactttaaatatgtcatgccattctctcctgtcctgtaaggtttccattgaaaagtctgctgccagatgtattggagatccattgcatgttgtttcttttctctagctgcttttataattatttctttatttttgacctttgggagtttgattatgaaatgttcttgaagtagtcttctttgagttaagtctggttgatgttctataaccttcttgtacttggataatgatatctttctctgggtttggaatattctcttttattgtccctttcaataaattttctacctctatctctttctgtacctcctctttaaggccaataactcttagatttgcccttttgaggctattttcttgttcttgaaagcatgcttcattgttttttattccttttacttttgtctcctattactgtgtacattcaaatagcctgtcttcaggctcaataattatttcttctgcttgactcattctactattaaaagactctgatgcattctccagtatgcctattgcatttttcagttcgagaatttctgcttgattctttttaactatttcagttaattttatctgatagaattctgaattccttctctgtgtgttattgaatttctttgagtttcctcaacacagttactttgaattatctctctgaaaggtcacatatctctttctccaggtttgttccctggttccttatttagtttatgatgtggtttagctgtgtccccacccaaaactcatcttaaattgtagttctcataatccccacatgtcacagaagggacccggttggaggtaattgaatcatgggggtgcttactctcatgctgttcttgtgatagtgagtgagttctcaagagatataaggggcttttcccccttttgcttggcacttctctctcctgccgccatgtgaagaaggatgtgtttgcttccccttctgctataattgtaaatttcctgaggcccccccagccatgctgaactgtgatttaatcaagcttctttcccttataagttacagtctcggatatgtctttattagcagtgtgagaatggactaatacagtaaactggtatcacagagagtcgggcactgttgtaaagatgcctgaaaatgtggaagagactttggaactggatgacaggcagaggttgaaacagtttggaggtctcagaagaagaaagaaaaatgtgggaaagtttggaactttctagagacttagagggctcagaaacaggaagatgtggggaagttttgagcttcctagagactcattgaatggctttgaccaaaatgctgatagcaatatgtacaataaagtccaggctgaggtggtctcagatggaaataaggaacttgttggaaactggagcaaagatgacttttgttatgctttagcaaagagaccggtgaaattttgcccctgccctagcgatctgtggaactttgaatttgaaagagatgatttagggtatctggtggaagaaatttctaagtggcaaagcattcaagaggtgacagagcataaaagtttggaaaatttgcacactggcaatgtgatggaaaagaaaaagccattttctgggaagaaattcaggctggctgcagaaatttgtataagtaacaaggagcagaatgttatttaccaagacaatgggtaaaatatctccaggacatgtcagagaccgttacagcagccccttccatcacaggcccagaggcctaggaggaaaaaatggtttcatgggccaggtccaggaaccccctgctccatgcagcctggggacagtgccctgcatcttcagttgcttcagctccagctgtggctaaaagaggccaaggtacagctcaggccatggcttcagacggtgcaagccccaagccttggcagcttccacaagatgttgagcctgcaggtacacagaagtcaagaattgagatttgggaacctccacctagatttcagaggatgtatggaaactcctggatgtccaggcaaaagtttgctgcaggggcagaacactcatgtataacctctgctagggcagtgtggaagggaaatatggggttgaaggccacacacagaattcccactggggcaccgcatagtggaagtgtgagaagagggccaccatcctccagaccccagaatggtagatccactgacagcttgcaccatgcacctggaaaagccacagacactcaactccagcccatgaaaacaactgggaggggggctgtaccctgcgaagccacaggggtggagctgcccaaggccatggcagtccacctcttgcatcagcatgacctggatgtgagacatggagtcaaaggacatcattttggaactttaaggtttaatgactgcactgttggattttggacttgcatggggactgtagcccctttgtttggccagtttctctcatttggaatggatgcatttacccaatgcctgtacccccattgtatccaggtagtaacgaacttgcttctgattttacaggctcataggtggaaaggacttgccttgtctccgatgaaactttgaatttggacttttgagttaatgctggagttagttaagaatttggggaactgttggaaggacatgattgtacttttaaatgtgaggatattaaatttgggaggcaccaggagtggaattatatgatttggctgttccctcatccaaatctcatcttgaattttagttcccctaatccccatgtgtcataggaggggcctggtgggggtgattaaattatgggggtgattacccttatgctgtttcatgatagtgagagagttctaatgaaatctgatggttttataagtggcttttccccctcttgcctggcacttcttgctgccactgtgtgaacaaggacatgtttgcttccccttctgccatgattgtaagtttcctgaggtctctccatccatgttgaactttgagtcaattaaatttctttcctttataaattgcccagcctcaggtatgtctttatttgtatcatgagaatggagtaatacagttcatttggtgagttcatgtttttcttggattgtctttatacttctagatgttcatcaggtctgggcattgaagagtatggtatttatcatagtcttctcagtctgggcttgtttgtacccctcctttttgggaaggctttctggatatttgaaaggacttgggtgttgtgatctaagctgtatctgttttagggggcacctcaagctcagtaacactgtggttcttgcagtcttttagagattctgccttaatgttcttagacagtatccagaagaattctctgcattaccagtcaaagacttttcttggcttcccttactaactttcaaacaaattaagtctctccctatgttctaagccacctgaagctgagagtggagtgacaaaagcacccctatggccaccaccactatgactgtgctgggtcagacctgaacccagcacagtattgggtctcactcaaggcttcctgtaactacttcctggctactgcctatgttcactcaaggccttggtgttctacaatcagtatatgacaaagccagccaggcctgtgtccttccatttggggtggtgaattcttccaggcccttggcagatctagacatgccatctgggagccagagactacagtcataaatagaaatctacctggtttttctcttgtactgcagctgagctggctcttaaaccacagcatgcagtctttcctactccaccttccccttttcataggcagaggagcctcacctcatggccaccaccaccgccccacaagagtaccgccagactactactgatgttcccttaaggcccaaaagctcttcagttagcttgtactgagtacttcctggcctgggactcacctttcagggcagtctcctccagtctggcccaaggcaggtccagaaatgctgtccaggaaccaagtcctcaaatcagggtccccaagagcctgcttgatgctctaacacactgaagccaagctcgtaccgaagattgaataaaaaaatcccatttacttttccctccacttttttcaagcagaaagcgtctagtaccatagccatcacagctgggaatgtactgagtctcacctgaagctagcaaatctcagagcctaatccaaggcctaccacatagtgtttgggtatcactgctggttattcagggcccaagggcactttagttagcaggtgataaatcctgccggggttcgttccttcctttcaaggcaatgggtttccttctgacccgctgtgtttctagaaatgtcacctgggagttagggcctgtaaaaagggcctcacaactctgactgctgccctgtcctgctttggctgagctggtatccaagatgcaagacaaaatcttccctactcttccctctcctctactcgagtggaaggaagcgatctcttttggagctgcgagctgtgcagctttgggttaggagaggaatgaagccagcactcccttagctgccctggctggtgtctccataggtcacatgtctccccacagtcagtccactggctctgggcccagtttagcactagaaatcacctacgagttgctgcccttgtggcctagactgctgttcatgtttacttagggctccagagcactttagcccaaggtggcaaggcttatggaaactgaagttgcaactgctgggatcagtgattcccctctggctagggctaggataaatactccctccatcggcaggcatcagctaagtttggtctggttttgctttctgttgtaacagggcagcactagttcaatgtctcacaattgctgtgttctccccctcgtcagtgtacagaacagttctccatgccacaccaccagtgacagcagattggggaggggtggtgtcagtgattcaagactgtttttcctacctcttctgtaactctttcagtgatatgtagttaaaatcaggcactgtgagtgctctcctgatttttaattcctatgaaggtacttttttgtgtgtgtatagatagttgttaaattggtgtccctgctgagtgggggagggacaatcagtggagccttctattgtgccatcttgttgtgccctcaacaacattttcaaagtgtatttttattgtctttttggtttctattgttgcatttaagaagtcaacataagtggtggttataagtcaagtggtcatatctatgtaggtagtatgtcttttctgttttgcaattttaaaaatctcttctttggtattctttaaattcattatgtactggctgggatctattgtaatgtattgagcttgcaattcattatggtacttgaagctaaggatgcatatatttcaacaattctggaaattgtagtccattactactttgaatattttttctcccctattttctcaaatctctcacatttagaatcgtaatacacgtatactgaaacttttgtttttatccttcatagtactatatctccctttcatatttcctatcagttatatgtcttaaatgtgaactgggcaatttttcctcatatgtattttccagttcactaatatctctttcataatatctaatcttcaatgtaacacacccactgaacttttattttcaatgactatttttcttttacagaaagtcaacttcaattagatatatctttttcaaatttgcttttactttctcccttcccctcataacctttataattttaattatagtttttttcataatcactactggataattatgttatatgaagtccttggaggggctctaattcagttttatcttgtatctgttgacccttacttgtaaccatttccttaggtgttttgtcattaaggacagtgaagtaattttcagcaagcattaatttgtggttctgtccttccagttttttgtgtgtttgctttggcaagtcaatctagtggtatacccagcttaagaccaatttttgtgttaagttttcagcttgtaaacttcagatcaggcagacagtatatattcggatgtcaatcccacatatgattagaattttgaggttgctacatttcagtagaaacactttctcctcaactcctccctcttcctttttgaacttttgtgttgtgatctgattttgtctagttaagttgatctagtttacccttttgctaagctcttaacagattcttggctttatgtgaaagtctagttccagcttctcatctgccacagtcctgcctcctcttcctcttaaaagtgttccagtttaggcaaccaattatatgatctttaaatctgtaggcaggaatgtttttggtctactaaaggaagagaaatgccagaatggctaatctttaaaggaaagagtgtttggagaataactcagagaggaaggcaagggccagcttatggcaaggaaaagttcatcccacatacgattggaagccattaggggattttaaaccaaagaatattcagcaaattctggctttcatttcttttaacctggctatctggaagtgtcccctgtgccttgtgtagttcagtggtcaaatatttgggcagatgttatactcagattttgggactcaccctctcagtggttctcttgttcccaggacatcctcatgaatttccatcttccaatccagagcttattctctgataagctaatactttttcagatttcctccacttgaattgtgatggattaaggaattccttcagtctaaatcgtagcaaattcacaaacatcacccagctcatttctttcatttagtggaccactatcttattgtttctgcctattttttttaactgggccccagggtctctcctatttgtgtgtagtatagtgatcagccggaatttttcggcagaatatatattcagatttggaggcccatcccttctgggattctcttacttttgagtcttccatccctaatggtccagattctctgccaccttgagccagtaagggtgttgtatatgccacaggaattctaggtttgggaagcaccttcaagaaagaaaaatcacaaactcacaattctaatctattgctgctgccatctttcaaaggtaaactcaccttaggtttctgtctgctttcagtcacgctccactgctttcaaggaatacaggtatatacagttgttgttcaggttttataattaatagctacaagaaaatgtaatcaaacaatttattatgctgttaccaatacctggaacatttattgttcatttattttgtatttagataaacagcaaatttgaatattttcttcacgtttattagcaatttttatccatttcatgactttgctgttcatttacccatttttatcttatttgtctataaggtatgttttttatcttatttatctataatatttcattatttattgaggataataagctatttgctaatcagacatattgttattttgaggctcagattaaatgtacgataaaatgtaaggttttggttttgtggcgatttttatattggcctttgatgttcatatggggtcattaagcagtagagacaaggtaagaaacttgttcttatttgggtgtcactgcatacaggagggagcacttgccttttcataaggcaaagtcttatgatcagcttgtgtgctgtgtggggatgtgttggcagttgtcttccttaaaaatgccttgtcaaatatgttatccccatgcttattaatctccatggcattatttctcaatcataatcattttccttacacaccaggagctactgttaatagactgctgcttctctgcatcagaggaaatactgcaaggtaattaatatttgctaagggcactatgagcccttaccagaactcaactgaaacattgttttctctcttttcacccctaggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggtcagagagtggtggttcccacccaaagtatattgggagtaggactgggcttgaaagcagaatgttttagagtatccattgaaaattccctcaagtgtatagattagaaatgtacaggtatgtatatacttcctaatacaattgcatgcatacatactcacagacatatatattctaataaacacataaataaagagttgcatagatgaacattttgagaaacacagaggtatacattcatgatttgtatatgcatgcatacctaaagacacatgtggactaacacagaaggacataatgtattcaaggacacttaaatacacagattcacaaaaacatacacacaggcatgaacgctgataattagaattgactaggtttaactgcaacaacaaactatccctatgatgcagagttgtgagaatcaaatgagataactatgggtattttgtgaaacatacagtgttttataaacataaatttaaaaatacttattttaattttttatttatttgaatatgtttattttatgctacattaccttaggatactgaggatgataataagtgaattttccaaacaatttaagattatatctctatctatctatacatggtgtttatatgtgtgtgcatatgtgtgtgtgtatatatagatatagaaatcttcataaaatataaattatatttcatacttttccaactcccaatggataaaaacatcacaattttatgtatttcataacttgttactgtcatagagttattaggcattgaattttgctgtcaaaaagaataaatttgaaaaaattttcagtgcaataagattctttccccaatactgaaaaacattcttggtttttgggtttgcttttttatgaatttgcttgttcctccgatatcagttgtcacttcctgaagcttccttccacattaatgagtgctaattttgtgtagtggagcttctatggctatttagaattggtgtatttgttattttgcagaacaaacctcaaataatgcatgcctggtaaataggtggtgaataaatgaagtgtgtttgtctgtatactaatctctcattacttcaaatttgctatttattggtgtttttcctacaagaatttggaagatgaggagatggtcaaggaaaaaaggataatacttcagagagaagttggatgagagatgggaggaaaaatgaacatagaggagaaatgagcatagagtggaggataaaataatgaagaaggaaagtggatagaagtgggaagatgagggtcaagaggggaggagaagactaattacacagagtacatagaggcatgtatattggagaaatgagaatggtgaaaagaaagagagtatgagaagagaggacaaaaagagtagagaagttgagaagacaaaggataagatggtgtaaaataaagaagctagattagatattaggatattctaaagagataggcgaatataatgaagtggatgtagtagatgggaataaagaggaaaagacatagagaagtaggggaagggacatgggaggagatgaacaagagggagggaaattgtagacgaaagaaagagaagctttccctcatttattcatttgccaaacatgttttgacttcctaatatatacatgaccctaaagtaaattctggaaatgcaaacattaatgagacataatctctgtccttaagataatcacaatataataggggagaaagactaataggataatagcaaattatgttaactaaaatgctaaagagatgggtagttattggaatatagagcagggtcatctaactcattgttttgggacaggttgagagaagagtccctggataaggcaacagctaggcttctgattattggtattagcattagcattttatattattatgtaagtagaatgcagtcaagaaacttgtaggtggataggtagaggcagaaggaagagaggaaggacgttctagacagagaaaaccaagtgagcagttgcagggaatggaaggacatattttaggcaagagactgaggtggtcagttttctatttcatatatggctctgtagttactgggtaaataatgcatttgaaggtaaaaagactggaattagataaaatgattaagaaacagctgaaatagtctagattagcagtggtgttctaattcagaacaatggattaagatggagaagtgacgatatgttaaggaaatcggcagtaaatatagaaaacttcagaatgacagagaggaggagttgtgaaggtagtaggtatccaaataacatgggtgaaagatggtactataggctggagtagatgatatgaaagttaggacaaatttagataagtctgtgaggttaatttgggacaagataagcttaaggtgattgtagattatccagggaaagaagtcttaacagcagttagatattcaagtcttaagatcaggagagagatacaatgtagagatataaagtgtggtattgttagtatattggaacaaatggaaacgtgaaaatggatgtcatcacttcaggaaagagtatagagtaagaagaatttcatgccaggtatctagtcatctagaactactatcagtaaggcagtggaggggaaagaggaacctatgaaagaaaccaggaagaaaatgtcagggagctgttaacaatgtgcagtatcatgaaagctaagtgtggtagtcaatattaccacttgccaatattttcacttcacctccatctggatgcaaagtagtactacacttccctgagccttgaagttcagcatggacaaatgacttgctttggctaaccaaatgtgagtgtaaatagtatgtgtcagctctgagagaggatgggaagcccctcaagagccaatacataatttgccatgttgccttcccctggccacagtaagtagcattatgccaggtggtcttggccctatcattctatgccccttattgaagatgacatagaagcgagtgggtcccacttccccaaccagaggtagtgtgagtgagaaataaacttccgttactttaggacactgagattttcagattgtttcctactgcatattaatctaacccatcttgactgataaattaaagtttcaaaacaatgagagttatcaataataacaccactaatagtataagtattattaattaacatcaatatagtacttaaaatatgacagacactgttctaatcattcttttataatattcataacagctttaacaacagtatgagataggtactattatcccaactttacagataaaaaaaaactgagacacgacgtgggtaacagaatttttcaagttcacttgggtagtagatggttgagccagcattattaatatggtagtgtagctgcaagttcatgcactttaccctgtttacacattttttacaacattgttggctataaaaagagatgtaatatagagacttaaaagtctgtcttaagtttggtaacatggaggatattagtgttcttcacatacactgtttcaatagagtggctagtgcaatggagagttttaggagttggagtggggagatagtgcacatagaaaataccttcgagaagcttgtttgaaaaatgaaagggagggaggtatcatagctacattcaggggtaaaagaaattgcttttgttttcagaggagagattgacacatatttgtgaggtagtacaaaagagtcagtaggaagacaaagatagaagatataggagaaataacacatcgctgacagcaagttctcataaataccatcaaggggatgatatcaaatctacagttagagttttacttgaaaggaagagggacacctcttctcacattgcatgaaaggttatgaggttatatataaatgttgaaatgaaggtggggaggataggacagagaaaaggtatgaatgagtgtcatatatcaaggagaatttggggaaacagagcattagggaaggaatagatggaagagaggcatgcttgtaataaattataggaaagagaagagtttgaaaaagagataagagttcacacaattgtggaaagaatggagtggagtatatgtaaacagaaaagaagctgtatggaatgaggtggatggagggacagaataatgaggaggagatgtggatgggcagaagacagtaagcaaatggaagagaagcaagaggaaggagagagtaatgggcaggaaaggatctgaacccagtagagattgcaaatagtgaggagaaatagagaatgaatgaaaagaacaggatagaggagaaacaacaataaaaggaataaagcatagagaataggtttaagttttggaggagggatagagaagagagaagaaaggagagaggatgggaatattgaaatacaaaaaaatagaaggtgcaggttgaggagggcagaggatgaagccgagcaaaggattagtttccttgaaatacagttgaatgaatgggaagatgatgataattgggccctttattctagtctgaattggacaagaaagtcaagttcgatgagattagagtctatgtagaatgcccttgtgcttattctgttttacagaatagaggaagtacagaagcacagaagcatgatgaagccatcggtttcctacacagtagcaccttggatccaggaaggtgggcctggagggagacataggctcaaaatggaaaaataaaagcctggctctttttacagccccacaattgattcacctagtgacctttctcaagtcacaaaccgttcactttctctagtctgataataatgtagctgctgccagtcttgcaggcatatgaaaagcacaaattgaataaggtctgcagaacacttagaatttttcagaaagtgttattctatagcacccctattattattttgaccctcaggaatcttatctggagtccatgggaaaactacagaaggacagcttcctactaaaatctgagcaagcattgcatgggtatgtaactagggcagtttagaaagaagccttgctttgcctcatcttgggacctcagaacaaccgtaaaaatacaggctaaaacccgttacctgctgcttacttcatcagcacacatactaaaattggaacaatgcatagataattagcagagcccagcccgagatgatacacacatttataaaatatgttctattattcaggtatggatatatagaaaacttcatctctattaatgtcatattatttgtatatgaggacacgggtaaacatgttcgttgtatataaatgttgcataatatataatatagtaaaaaagtcctattgactatctgaatatgaaggagaactatttatggaatttaactagattttatcctattgacttaaaacattcatcagcacattcacgagtgcttactatgtttaaagttctggaatatctgctgagctacagagataaataaggcacaggtcatgctcttaatgactctacagttaaagagacctgtgcacagatagctgcacaataatataaaattcctgaaatggaggtgcaaaatgtgatagaatcgcaggagaagtcacatctaaaatgatatagggttatcaaagaaagctgcaaaaggaggtgctgcatagtttgtcccttgaatcttgaaggaagtgtaggtgactgtcaaacaaatgagagacagggctgaggtagaggagggttttccaggcagaagaaatagtatacacaaagacatgtattcatgaatcgacatcatgcatcagaaaatccatgcttctttgtgagacatgataggggaaagagagagtactatgggagcatctaacaaggacagtgaaatgagtctgtggggtatagccacaataaattccagaggatatcaccttctgaatgatttctgagacctaaaagatctgtagaagtaaattaaaagacagggaggaaacattgcagagatagagcatagcatgtataaaggcttgaagagtgagaggagaaggtagtgatgatacattgaaggactaaaagttcagtgtgattggaccagagtacagtgcaggaaagcagtccgaggtggggagaggggcttatacgctatgttggcataaacatgatgaggatccactaaagactttattgcggaggaagaaatcaaacaaatttgcatttaagatagatcactctgggagcagtgtaggaggcagattagaggaaggcaaggctgaagatgaggtacctagctaagaagctgccataatactcaaatgataatcctaatgacaactacgtattatatatactgtgtatatgtagtatactatgtgttgaacacctactatttgttaggtactttacgtaaaacatctctaatcttcacaacacttattctagcttcatgttactgctctttccactaaattaggttttgaggaagaattgtgggcatacaatatgttcaagaggtaacattgatggcacttggtgcctaattggaagtgtggagttcaggaggttgtatggctggtttctacaagtaaataagttgcctaggataatggaagtattaggggtgtaatataaatgatgacccaattgttaacatttccgtagaacaaagaggagtaataagattttggaacatggcagtgataaagggagtaggaaatatagccaaatagcatacctatttggaaggatttgtgcatgacagatgagggatgatagtgaagaagtgatacagaatatgtttatcctgtagttacagggaagcattattgtttttacagatttatttatgttttgattgacatataaaattgtatttactgtgtacaacatgatgttaagtacatatacattgcagaataattaaatctagctaattcgcaaatgcattacctcacatagttaacgttttgtgatgagaacacttgacatccactgtcagcatttttcaagaatgcaatatatcgtcattattgtcagctagtcaccatgcagtatgatagatcacttgaacttattactcctacctaattataaatatgcatcctttgaccaacataatgtattttttaaagtgaaagacatgacaagagaatttgtgataacacaagttgctgaaccccaaaatgaataacagttcaaacatgatagaagtgtatttcttgctccttaaatttcaaagcaggtgttccccattgacaagcggctcatttccaagtggtgcaacacatggttttcttttttttttaaattttattattattatactttaagttttagggtacatgtgcacaacgtgcaagtttgtttcaagaccactgtgcttatttgtattaagtcagtagaagatgaaagagcacgacagattgtatatgggaggtatttatagaccaggccttgagtggcatactcatgtctactgacgttactttaactagaatgaggtcacatggacatggtgggaaaagaaacattaccaagaaaatgagaaagtggatttggtgaacagttggcaagtgtttgccaatcccagtttttttttttaaattgaaatccctggttgcattctggaagataaatagaaatactagttaacagaccctttcatagtccaggaaggaatgacagaggtccaagaaaaggcagtgagaagtgagagtggaagaagaagggcaagtataatgagagacgttttcaatagatgttgaagtccaactggatatagggtatcgaggaaaaaggtgcgttgagaatgtccctgacatattctccctggatactgagtgaattattaacgacaacaaccaccacaacaaaaactcattataggagaagaaggagatattttggagagaggaggggttagagagtttacatatcttggggatttgctatatgccacctgttgtgctagttgcttcacatgtatttgttaaatttaatcctcacagcaatgttcatgtgtatatactacagaagcataatatagcatggttattaagaaggtgggttctgcagtaagactgctcctggtccttcctctgtaaaataaggcaaatcataacaatgcctgcctcatagaccattgcaggaagtgaatgcgataaggcatgtaaattgcttgatatacttcttggcattctgtgaagtgttttcatttttattgttaacatccctatttttacacttagtaaactgaagtttcaatagagcaaactcacaccaccaataagtggcagagctggtatagagacccaagtcattctgctagtgaaaaccttttttcccctttacatcccatcatttcctctaataagggagggtgtggcctatcaattttaaataacaaatctgaagtggacacgacaagctgcagttggaaatgcaggtctggaactcaggaaaacattgacacagtgggattttgtaaaactgaatacattgcacaaaatgtcagctatgggttacgttacacagtaatagtgtcctgcatttagctcaaaggaaataggcgctagtttctccatgtttaataatcaagaggaaagtggtgctctgaaccaattgagtgagggttgctatcatattgagaccatgaaattttttattgtatgactgagtcagttttatgtgctttgaatattccaaagacaaactatgtgaaggctaaattctgcatgtcaggagccctcctcccacaaacttcatcagtaaaattcttctcctacttatttagatgcaaatggcttgcacttgtgttttcattatagactctgcctctgaaatggccaggaaccagggaaagcatttgggccacactgttagttgtataggatttaatgtaatcagatcaaccaagcattgatagcttgtttcacacagtctttttttttgtaatggcttttgctctaggggattccacctgtagtttcttattcattaagctagcaactgactcacagagccacacttagtgaatctcactctaatgaacagaagtaagagcatagaagagatggagtggttcattttggtctctgagaaagcttacaatgaggtgagaaggaaataatggtgtaagtcctcagtcaatcccaaattactgtgtgcacttcatgcaaggacatcagctcctgccctccaagagctcatatcttaggaggaaagacagggcacatcattcactgtaccaaaaggcataatggaagtttcacataaagctaacagtgaagtgctatgtgctaaaaattacaggattcactgaaacttggggacatggacccagatgtgtggcagggcttcacaggggaactaacatttgagctggaaggtggggaggaaaaaagtattcctgagaagtttcctcacatttatttcatttttgccagttccatgtggaaatcatggccttgaaataacaaggactgcctttattctccaagcaagaaactggtctccaggcaaattgagtctgtttaaaagttcattctaacagagggatttacaggtcaaagtaagtgtccctcttgttccaaagaacccagctattttagatgctacccctagacagagtagaaactctgttgtaatggaataaacatcagagaaggaattaagagccatgggtgtgaatcccacctttggaacagatcagcagtgtaaccatggacaaggcatttctcttctctgggtctcggtctcttcttttgggatacattgctgaaaatacctgctctgcctatctcacagaaatatttattaaatcaggaaacagctgtcaaccatctgctatgtgccaattaccataccagggatgggattacaatgatgaagagaccactctctcaagttgcttatagtcctgtgcagaagacagagagctaaacagacactaataatcctatgtggtaacgtctaagactgttgtccaaagagcccttagattgctgtgagctggaggaaaccacagtacttgtagggcacagacgaacatcatggaagagggaatatttgagaaaagacttgaaggaaatatgttgtgcctataaaaaggaaagggtattccaggcaggaaaaaaatgtatgaaaagacacagatacatgagagttttgttttgtaaaattataagtttttacagatggctggagaatggaaatgaggttggagctacacctctgagataattgttaaaactcagatgtgctccctctgaaggctaaatggagcagtaaagtggtggccctccttcctgcgtactgagcttcttgtctatagcttgaagatttaatgggacacctcagacaactggcattctcgtgactaatgtgctgcttggtttgggtgtttggtggtagtatatttcaagtgactcatgctgtactgataatggctattaatgatttgttattctttctttttcaccataaatcccaaatcctgccctttactccattattatagaaatagctggcctggcacctcaactgctcctgaagcagtgttatttgtccttagagagagcattcctaagagttcagagtaggttgttccacttcgagaaggcctaattgacagattgctttcggtatggctcatactgaattccagagccccttgttctcctacaaagttcaaactgttccctcctacattatacttaaacacagtgatagcctcactgaacaaccagtacatatattcaataaactttagatttttaacctttaggattctagttagtgtgggaaccttttttctctaaccttatttatggttttctcctattttatgcccttatttaaaaaataatcagtattctatgtgcaaaagtctaagaatgatttgatatttttctgtggggcagttaatttaggtgactctttcattcaattaattttgcagatttttttaattctttaattgagatatagcttgcatattttaaagtatacaaatattatgtgtatagctccgcagtattctggataaggaatatgtgctagaggttgctgcattagaagggtaaagtaatggagaagtagcttatgataaccagaacctcactttccagaagtgtcactctccgtgggtcgaaggcaaatgggcactgtcttaatgcatttgaactgctataataaaacaccttagactgggtaatttataaacaacagaacttatttctcactgttcttgaggtcaggaaggccaagatcaaggctccagtacattcagtgtctaaaggctacctctctgcttcaaatatggcaactttttgctgtgtcctcacatggcagaagagactaacattttcctttaggtcacttttatagggccagtaaccccattcaagaggacagagccctcctgacctaatcacttctctaatgccctatcacttaatactatcacattagtggttatattaatatttcaacattttaatttcagggggacacaaacattcagaccacagcaggcactgaagacatggatgtaacagtttctgagttggaaaatttactcattgggttagtgtgttgcatggatttccatcaaaaagcaaatgacttacatgtggtattcaatctagttcaggagacaagacatatgtaccagcaaaaatatccttaatatgcaaagcactgtataataaatgcaaagtaaatactggcttttgtatcaatggtataataaaatgttaaaaatcagcaaatcatacagtaagaataatctctgatatgtttgcttgttttgaaaatgtacttaggtatttccaataaagatgagataagggcaccaaatagccaagtcactaatttgtctctattccaaaggtatagaaagaaattatttaccctgtgacttttagtcaatagcagggattttgaacccaatgagatggcatagcataattgctggaccaaatgtttcaaatgaccatatgcagtttatggtttactgcttgcttcatttcccctccctccttcaagattctgatacatataccttctgcctgagatgtgtggagagtcagtggaaagacatgaacccagtatgctgaatctcagtcgttagacttcttgtcttccctagatacatcactccttttgtagtatcatctagtcttagggcttcaattagcatctgcaaggtgttagctaacaagacacagagaactgaagtaacttacacatagctactactacaagctgggttcatggtggacctgggttttaaatctggcagtctggctttggaatccatgctctgtttataataaataaataaaaataatatgtatttatggtgtacaacagaatgtcttgatatatttatgcattggggaatagctaaatcaagctaattttcatatgcattacctcacatctcaatttttgtgctgagaacacgtaaattctgctctcagcgatttttaaatatataaaacactgttattaactatactcaccatgttgtacaatagatctcttgaatttatttttcctgtgtaactgaaattttatattctttgaccaacatctcctcaatcctcccacttcctggccaccattctactctctttctatgagtccaacttttatacactccacatataaatgagattgtagagtatttgtctttctgagtgtggcttattttgcttaagataatgtcctccatgttgtcgcaagtggcaggatttccttttcttctaaggccaggtagtattttattgtgtatatataccacatctttttatccatttatccaccaatgaatgcttaaattgattccgtatcttggctattgtgaataatgctgaaataaacatgaaaatgcagatatttcttcaacatactgatttcatttcctttggatgcatgtacacacagtagtgggattgctgggttatatggtatttctatttttaatttttgaggaacctccatactgttttttataatggccgtatgaaagagttctcttttctccacattctcgccaacacctatcttttatctttttgatagtagccatcctaacaggtgtgaggtaatatctgattgtggttttgatttgaatttctctgattatttatgaagttgagcctcttttcatacatctaagacaaacatttattcagatcctttgcctatattaaaaattgggctatttgttttcttgctattgttgtttgagttccttatgtattttgaatattaaccctttatttgatatatagtatgcaatattttctcccgttccataggttatctcttcactgtgttaactgtttccttggatgtgcagaagctttttaggttgatgtaatgccatttggctatttctgcttttgttgcctatgcttttggggtcatttgcaaaaaatatcattgcccaggccagtgctgttgagctttctctctctgttttcttctactagttttatagtttcaactcaaaatatattgagttgacttttgagtatggtgtaaatggggtccaatttcattcttctgtatgtggatatcctgttttcccaacaccatttattgaagagactgttctttcccccatagtgtgtccttggcatcttttatgaaaaccaattgactgtaaatgtgcagatctatttctgggctctctattctgttccattggtctatgtgtttgtttttttgttagtaccatgctgttttgagtactatagaaatcaaataggaggagccaagatggccgaataggaacagctccggtctacagctcccagcgtgagcgacgcagaagacgggtgatttctgcatttccatctgaggtaccgggtttatctaactagggagtgccagacagtgggtgcaggccagtgggtgcgcgcaccgtgtgcgagcccaagcagggcgaggcattgcctcacttgggaagagcaaggggtcagggagttccctttctgagtccaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaagcagcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagagaaacaaaaagacagcagtaacctctgcagacttaagtgtccctgtctgacagctttgaagagagcagtggttctcccagcacgcagctggagatctgagaaccggcagactgcctcctcaagtgggtccctgacccctgacccctgacccctgagcagcctaactgggaggcaccccccagcaggggcacactgacacctcacactgcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctcttctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtacttaaaggagctgatggagctgaaaaccaaggctcgagaactacgtgaagaatgcagaagcctcaggagccgatgcgatcaactggaagaaagggtatcagtaatggaagatgaaatgaatgaaatgaagcgagaagggaagtttagagaaaaaagaataaaaagatatgagcaaagcctccaagaaatatgggactatgtgaaaagaccaaatctacgtctgattgatgtacctgaaagtgatggggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacgttcttaaagaaaagaattttcaaaccagaatttcatatccagccaaactaagcttcataagtgaaggagaaataaaatacttcacagacaagccaatgctgagagattttgtcaccaccaggcctgccctaaaagtgctcctgaaggaagcgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcagcaaacccatctcacgtgcagagacacacataggctcaaaataaaaggatggaggaagatctaccaagctaatggaaaacaaaaaaaggcaggggttgcaatcctcgtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagaaaagctctcctcagcaaatgtaaaagaacagaaatgataacaaactatctctcagaccacagtgcaatcaaactagaactcagtattaagaatctcactcaaagcctctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaacagctagcagaaggcaagaaataactaaaatcagagcagaactgaaggaaatagagacacaagaaacccttcaaaaaatcaatgaatccaggagctggttttttgaaaggatcaacaaaattgatagaccactagcaaggctaatgaagaaaaaaagagagaagaatcaaatagacacaataaaaaatgataaaggggatatcaccactgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggagctgaaattgttgcaataatcaatagtttaccaaccaaaaagagtccaggaccagatggattcacagctgaattctaccagaggtacaaggaggaactggtaccattccttctgaaactattccaatcaatagaaaaagagtgaatcctccctaactcattttatgaggccagcatcattctgataccaaagccgggcagagacacaaccaaaaaagagaattttagaccaatatccttgatgaacaatgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgataaaaactctcaataaattaggtattgatgggatgtatttcaaaataataagagctatctatgacaaacccacagccaatatcatactgaataggcaaaaactggaagcattccctttgaaaactggcacaagacagggatgccctctctcaccactcctattcaacatagtgttggaagttctggccagggcaatcaggcaggagaaggaaataaagggtattcaagtaggaaaagagggagtcaaattgtccctgtttgcagatgacatgattgtatatctagaaaaccccattgtctcagcccaaaatatccttaagctgataagcaacttcagcaaagtctcaggatacaaaatcaatgtacaaaaatcacaagcattcttatacaccaacaacagacaaacagagaaccaaatcatgagtgaactcccattcacaattgcttcaaagagaataaaatacctaggaatccaacttacaagggatgtgaaggacctcttcaaggagaaccacaaaccactgctcaaggaaataaaagaggatacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatgacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaacaagaaatggggaaaggattccctatttaataaatggtgctgggaaaactggctagccatatggagaaagctgaaactggatcccttccttacaccttagacaaaaatcaattcaagatggattagagatttaaacgttagacctaaaaccataaaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacaactaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaagacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggacaagatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaacgtccaacaatgatagactggattaagaaaatgtggcacatatacaccatggaatactatgcagccataaaaaaggatgagttcatgtcctttgtagggacatggatgaaattggaaatcatcattatcagtaaactatcgcaagaacaaaaaaccaaacaccgcatattctcactcatatgtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaaataaagataccctaaaaaaaaaaaaaaaagaaatcaaatagtgcaatgctttgttctttttgatttgttatttttgcttaagattgctttcactatttggggacttttttggttccatacaaattttatgatttctttctatttctgtgaaaaatgtcattgaattttttataagaattgcattgaatctctagctcactttgggtagtgtcaatattttaataatatgaattctttcaatccatgaacacaagatgattttcaatttatttgtgtcttcaatttctttcatcaacgtttagtgtacagatctttcatctctgaaaatgttaaatttattctcaagcatatctttgtagctatagtgaattggattattttcttgatgtattttttaaatagtgtgtagaaatgttactgaatttttcccgttgattctgtatcctgcaactttactgagtccatttattagttctgacaattgtttgttggggtctttaggattttcaatatatgtaatcatgtgatatgcagacagagacaatttaatgtcttcctttcctatttagatgtctgttatttctttcccttgcctaattgctccggctgcaaaatcccagagactctaccaaaagactcctaaatttgataaatgaattcagtcgtttcaggatacaaaatccacatataaaaatcaatagcatttccatatactagtaatgatcaagctaagaaacaagtcaagaatgcaagctcatttacaatagctacaaaaagtatgtaggaatacgtttaaccaaggaggtgaaagatctcaacaacgaaaactacaaaacaccgatgaaagtagtaaatgacacaaagaaatgggaaaacatcccaggcttatgcattggaagagtcaaaattgttaaaatgaccacactattcaaagcaatctagagattcagtgcaattcctaccaaaataccaatgtcattttttcacagaattagaaaaaaatcttaaaattaacatagaaccacaaaagagcacaaagagctgaagcaatcctaaacaaaaagaacaaagctggaggcatcacattacctggtttcaaattattctacaaggctatactaacccaaacagcatggtattggtatagaagtagacaaattgatcaatggaaaagagtagagaattcagaaataaagcttcatacctacagccaatcgatctttgagaaaatcaacggaaacatacactggagaaaggacaccctattcaataaatggtactgggaaatttgggttgcaatacgcagaagaaggtaagtggacctctatcttttaccatatacaaaaatttactcaggatggattaaagactcaaatgtaagatctgaaactattaaaatactagaagaaaatctagaaaaactctactgatcattggccttggcaaagaatttatgactaggatctcaaaaggaagtgcaatgagaacaagaatagagaaatgggacttaattaaatgaaaaatacttttgcacagcaaaagatataatcaaaaaagtgaatagacaacctgcagaatgagagaacatatatgcaaactatgcctccaacaaataaatgatatccagaatctataaggagcttaaacaaatcagcaaggaaaacaaaaataaccccattaaaaagtgggcaaaggacaagaactgacatttgtttttcatgtacttatttatttattttatttattttttttgaggggaaaaacatttttattttttaattttttttattattatactttaagttttagggtacatgtacacaatgtgcagcttagttacacatgtatacatgtgccatgctggtgcactgcacccactaactcctcatctagcattaggtatatctcccaatgctatccctcccccctccccccaccccacaacagtccctagagtgcgatgttccccctcctgtgtccatgtgttcccattgttcaattcccacctatgagtgagaatatgcggtgtttggttttttgtgcttgcaatagtttactgagaatgatgatttccaatttcatccatgtccctacaaaggacatgaactcatccttttttatggctgcatagtattccatggtgtatatgtgccacattttcttaatccagtctatcattgttggacgtttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagagttctatttctccacatcctctccagtacccattgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcgcactttttgatggctaaaacaccaaaagcaatggcaacaaaagccaaaattgacaaatgggatctaattaaactaaagagcttctgcacagcaaaagaaactaccatcagagtgaacaggcatcccacaaaatgggagaaaattttcgcaacctactcatctgacagagggctaatatccagaatctacaatgaactcaaacaaatgtacaagaaaaaaaaaacaaacaaccccatcatgaaccgacatttttcaaaagaagacatacaagtggccaataaacatgataaaatgcccaacatcactagttatcagtgaaatgcaaattaaaaccataatgagataccattttccaccagtcagaatggctgttattaaaatgcaaaaacaaacaaacaaaaaaacagatgttgacaaggatgcaggtaaaagagaatgcttacacacagttgggaatttgaattagcataacctctatggaaaacaatatggagatttctcaaagacctaaaaatagtagctccatttgtttcagtagtctcgctcttgggtatctacacaaagacaaatcattatatcaaaatgatatttgtacttggatgtttattgcagcactgttcacaatagcaaatatatggaaccatcctaagtgtacattaatggatgattggataaataaaattatatatatatgtatatatatataatgctgtatatatatacacaatgttacatatatacacacacacacacacaatagaacactatttatcaataaaataatgaaattatctctttttcaccaacatggatgcaattggaggtcgttaccttacgtgaaacaactaagaaacagaaagtcaaatactgcatgttatcgtttataagtgggaactaaataatgtatacacatcgacatagagagtggaataatagacattggagagttgaaagggtaggagagtaggaaggggtgagggaagggaaattacctaaatggcacaatatacattattcgggtgatagttacactaaaaaccgtaatttcaccgctatgtaatatatctgtgtaacaaaatggcacttgtaccccctaaatctacaaataaattaataaatggctaaggtaagcatgctttctaaaaagaaaaaaaagaatccatgctcttaaacactgtgctataaggctgatattgattcatttaaaataaaaactttttgaagtataacttacatattataaaatttattttacatgtacaattcagtgatttttagtagatttatagaattgtgcaactgtaaccaaaattcaagtttagaacatactatcacttccaaaaatctctctacaaatttgtagtaacactctgttctcaccccaacaccagtcgactactaatgtactttctgtctctatagattcgtctttcttggacatgtcatgtgaatggaatcatacagtgtgcgacattttgtgtctcgctattttcacttagcataacacatttgagattcatccatgccattgtgtgtattccttttttcttgatgattaacattccattgtatagatataccacatcttgttcatccagtcacaataatggacatttgggttgtttccaccttttatctattgtgaataaagctgctataaacaggtctttctttggacatatgttttcatttatctttgttagtgaataattagagtaattaaagtaagaattagagtaaaaccacagggtcttacggtaagcttatgttaaactttttaagaaactgccaaaatattgtccaaagtgtgatttccatccaccataatttatgatcttatgtttttcccaaatccttgtcaacatttgaaattgttgatcttttttattttagccattttagtgtgcatgtagtagtatctcattgtagttttaatttgcattttttaaatgactaatgtcgaacatcttttcatgtgcttattagctaacagaatatcttatttgcatatatacatatatacacgtatatacacacgtgtatacacacacgtgtacacacacacgtgtacacacacgtatatatacacgtatatgtatacatatatacgtgtatatatacatatacgtgtatgtatacatatgtgtgtatatatacgtgtatgtatatatatacatatatatgtgtatatatacatatgtgtgtatatatacatatatgtgtgtatatatatatatacacttctcatttttgtattaggttgtttttcttctcattattgagttctaagggttatttatgtatttttaatgcaagtcctttatcagatgtatgtttcacaaatatattcactttctttgtgccttgtcttttcattttcttaaaggtatcttttgacaagcaaaagctttgaatttttatgaagtctaatttatcatatttttttcttgtatgcatcatgattttggtgtcacacctaagaaatctttgtgcaactcaagataacaaagattttctcctatgttctcctttagaaattttagctcttaaatttcgatttatgatccattgttagttgatttttgcttatggtgtgaggtaacagtctaagttcatatcttgcacttgtatattaaattctcctagaaacattgagaaagctattttttgtctccactgaattgcttggcaccttggtcaaaaatcaattgactataaatatcaaagtttatttctggattttctatttttttccattagtctatattataatatttaggccaaaactgcaccatattgattactgtagctttaaaactggaaagtgtaagtactcatgattttttttgaaagatgctttggctattctagatcctttgtgttctcatataaattttagaatcaacctgccattttcacaaaaagaaaatctgggattttgaaagcgcatgtgttgaatatatagagcaatttggagagaattgccaccttaatgctattaggacttctaaatttgtgaacacggaaagtctgaacatgtcaccttcaaataaagacagttttgatttttgctttccaatcattctcttatattcttttggttgcctaattatttagacagctttattgaaatatgattcacatgtcatacaatttatcctcttgaagtgtacaattaaatgatttttaatatattcacagttgtgcaaccatcaccaagatctaatttcagaacattttagtcacctcaaaaaagaaactccataccattagcagtcattccccatttcttttcttctttgactggctaaattcttcaataagaagttgaataaggaagaaaaaacatccttgcttgatcttaggggaagtatcttagtctttcactattaactatgatgctagatgagggttttagtaagtgccatttatcagttgaggaagttgccttctattcctagatttttgagagtttttaatcataaagcagttttagacttcatcttcctggttttgtttttgacctcctttaactttttctctataaagttgtcataattttaaaatgttagtttgatcaaattaccctctgcttaaaatcccacagtgcctctatatttcactcatagtgaaagcaaaaatatccaggagcccttatactatctagtttatgccacatagcttcctctttgaactcatcttctattactcttccccttgatctctacaagacagccacagtagcctagttgctatttcttgagcaccctgggcacacttctacctcagggcctttgcactgctaccccttctaacttgaatgctctttccccaggtttctacaaggctcattctctcatctgcttcagattgttgctcaaatgtcacctactcagtgaggtacctgctaaacaccctattaaaagttgcaaccccttccaaagcatggtaaaatgagagtcataactgaaatatgtatgtgggggagaagggtgcagatgcagggccaaaaaggtcgtcagattttcatttgtatcctcgtctcccaaagaaggggcttcctgggttgcctcttactttgtatctgatcttcgcataaagagcaaagcaggccaacccctgtattgcgactatagttctatgatctgaatgccacattttcaggggattctgaccttttttgaaaagctcactgaaaactgctagcaaaaatacaaccaaacttagtagagcttcacaaatgaatccatgaagagggagaaaggttggaaaaggagagaggacatggaatttttacagggtttattttgctgatctgaagtcagaggcaaccatgtcacttaaaggctctgattctgccccagctttctctttgaaattattttttatatttagtaaaaataataatgatgatagtgataatcctctggaatagataaagactttgatttctttttttctaatctgtgcctcctaccaccctataaatccctgatgttgttaaatgaataaatgttgaatggatggatggattatgtaagggaaggggatattgtctctattcctttttataggtgagggaactaaagttcccttggatatttacaaaatttccgatgtgtcttggacaaaagctgaattctgaagctagcctgcaatgctccaccaatctgacttttattcttaaggcataaaaggggtttcatgactcaaagaaccagacacaagagaaacgtatttcactgaaaaacatgctccttgtgttggatactgaaaagattccatgagagtttaataaagaaaatggtgttccttttctccacttatattattatttccaagacactgcctcttatgagtaatgccaaggggaaattactttatgtctagccagcagttctggggacatggagaataagatcacaacaaatagactatcaaagcaggatgcaaaggtagtgatttctgattaggggcaaaactgatttataataacttttctatctttcttcccatccacttcttgctcaacccacctaagcacagaggagacagaaaaagcaaatgtttgtaggggcaaggtacttcataaaccaaattatgttgtgctcttttcattagttcttaaacatgtcaatgctgtctgatcttcttgccctccttatctcccttcacatattgagataggattgtcaatatcccttcaagttttttctgcaacagaaagcactctgactgtattcaggctaatgtactcaactcttgccctgtgtcaatggttaactgcatatgtgagggttagctttctcttcctatagcagtggtcactatgagggcaatgattgtagcttgtgcctctggttcttccttcttttcttagtatcttcacatgactaccttatacatagaacatacttgctcaaagataaccaaagataactagagcatctctcatatgacttaaagattactgaggacctgaggagaccgttaccctcagatgaatggaaaattgctagtgtagaaagaacaccagatttgcactgcagctctccgggttgtgtgacttgagaaactcactttaacaccatgaattcttatttttgaaataaagatgataataatgtctgcaatatgtccctcacagggtcactatagggagcaaattaggtaaatagaatccttagttccaggcaaccagggtccctacatcacaaatgttagcagtaggcctgagtggaattactgatgggaatgttcttttttttttaaaaaaaaaaatgtaacccatttaattatgagtttatacaatttaactttttttaatatatatatatatttattatcattatactttaagttttagggtacatgtgcacaatgtgcaggttagtcacatatgtatacatgtgccatgctcgtgtgctgcacccattaactcgtcatctagcattagttatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggaaatgaactcatcattttttatggctgcatagtattccatggtgtatatgtgccacattttcttaatccagtctatcattgttgggcatttgggttggttccaagtctttgctattgtgaatagtgccacaataaacatacgtgtgcatgtgtctttatagcagcatgatttatagtcctttgggtacatacccagtaatgggatggctgggtcaaatggtatttctagttctagatccctgaggaatcgccacaccgacttccacaatggttgaactagtttacagtcccaccaacagtgtaaaagagttctatttctccacatcctctccagtacctgttgtttcctgactttttaatgattgccattctaactggtgtgagatggtatctcattgtggttttgatttgcatttctctgatggccagggatgatgagcattttttcatgtgttttttggctgcataaatgtcttcttttgagaagtgtctgttcatatccttcgcccacttgttgatggggttgtttgtttttttcttgtaaatttgtttgagttcattgtagattctggatattagccttttgtcagatgagtaggttgcaaaaattttctccccttttgtaggttgcctgttcactctgatggtagtttctttagctgtgcagaagctctttagtttaattagatcccatttttcaattttggcttttgttgccattgcttttggtgttttagacatgaagtccttgcccatgcctatgtcctgaatggtaatacctaggttttcttctagggtttttatggttttaggtcttaggtttaagtctttctttagaaggtgtaacatactgtgagcatctcataggttattagcaatgatcatcataatgataacaattatacattgaaccttctatgccttcatagacacatggatgtctgtaatttgacaagaaatatctcctggtatctcactctcattaaccaaagaaaaaccgtgttaagcagcaatagcctgcggatattttcttgttaagatcttgcttcctaacactgttacagtagcactgtgatgtgaagagtgagaaatggagacaccacacatgggatcccttgcatgcacttctttatttgttgcctcaacaaaacacttccccacaggcttctttggtaattgcatagaagtgaggcatgtttttttcagtctcatatattgatattttattaggcgagatttctggtcctaaggagtacttgggccctgtaaagttctcagcaggagtgcctatctaagggaagaagccattgggggaatgggtgacgctataattgataaccagtttctcaacttattagaactccaaaaggatggcagaggttgagtccaatataaccaggaagtataaaggctagttagaagtagctcatgacggctagcttccaagctactcttaggttttgctgtgtgagccccatttctacataggaggctactatctaacccgaggaaagttaagccttgaaaaaaataaaaaaaaaaaaatcagaaggggaaaccttgaaatagactattcagagagactattgcaggggaatgagtatgtaaacatgtcatacaccattcagatttccactgagcaatccatccagcatcttttccaaatgttgcctctgttgacagagcatgagctctttagacttgacctctgaggtttccgatgtcctccatcacctttgtattttttcctggagtggtcagttttcgtgtgtgtgtgtgtgtgtgtgtgtgcgtgtgtgtgtgtgcgtgtgtgtgtgtgcgtgtgtgtggtgtatgtgtgtgtgtgttcctcaagagccatctctttcaacaaagctatagcagttcctgtgagcagcagaattatgttttttgtctgtctgttaatgatcagggtaaagatattctttctacatatctcttctcttcagtgcaatctttaaattggttaactcacagaatagcctgctgagaagaaatatttcggaaataattaaactgcaatcagaagtgaatgagtcagaacctggtgtttccaggcttcttggggggggtgtctaaggaagtacagttagggcagaaaagttatatctgtttttcaaaggtgacaggatgggattcagatatgatgatatgatccaaaaatatgagtacttaatgcctctttgagaggctatctagttcattttatccatcctttgtgttcataaagacttgaatctcagtgaacttaaacaaacaaaaatctcgttattcttaggaactgagtgggaatgcagccctgtgtttaataacatttattttagcttaatttcattttctgtttgcctttcttttaggttaacaattcatgctgagtgtcccatgcatttggaagattttcccatggatgtgcatgcctgcccactgaagtttggaagctgtatgtattttctctctctctctctgtcttttttttttgcctgatcttccaaaagaaacttaacatattatattctgtccactgcaagtttctaaagctgaggcctttaatccgggctggtatcagggtgggtcagagagtggggttgagtagtactaactaatcagggggaggagacttagcctttaacaagaattttctttctaagaagtaaactttattttgctatttcagactaatttctctgtcattagattgaaacattaatgtctgttttctaaattgcccaaaggacagagcaagacagaagtgatataaaatacagtcacagctacctaaggacaagatatgtcaaacagaatgtggttagattttttgaagtgcgtattctacctgcatcttcatatacttctatccaattcttaacagtgtgtgataggcaggaagagactctgaagatttgctcacttttgaaagtattaccttttccagtagctgtacattttacagaaaaagtagtaaatatatagtccattttcaaatgaattagaaaaatcaacattgaatagaatttgagtgagtttttgaactgaaaaatttcagagtgagtttcacatagagagtcatcagagtaatataccaaaatctgtgttgatcatgtcaaaattaatttagctgtgttttgaaacagaaagtgcatttgaaaagacccaaataattaagtgcaacatgtttcctcaatcattagtttttcagatctttacagattgtattctgtgtgccaggttctattctaggagcttggaatgcatccgtgaataaaacaaaagccttgctcttttggagctatattatagagagacgagtggcagtgaaagataaaataatggattaaagggtaaagcataaggcatgttgtaatatgagaagcaacatgggaaaacataaaagtactgcagaattaggggaatcatccatgcctaggtggaggatttgtgttaccactgaaattgaaagtagggtgattagtgtcaccctaattatttaaaaggaacattcaagcagaaatattaagaaaatagagagcttatcaatgcatatatatatatatatggaaatagagctctcagtagaaggaacaaccaggaaaaataccgtatgtctgaaaaataggtgacttgttcagccagtgtggctggccagagtgaggaaggggagagcaggagaaaaggatgagatcaaagtgggggccaggtaatctaaagtcttataggccattaaaggtctttgaattatattctaaggaaaaatgaagaacaattagaatattttagacaaaagaatggcattatctgacttatgtcttaaaataattactaggaatttttaaaatgatataagtagaagagggatcaaaccatgtggagcccaagtaggaggtgactgcaatatttctgggtaggacagagttgtttattggtgaatagtgttcccttcattaacaactataaaacctagaaccatagaaacaataaagctcagtgaagattgaagtgtctaaaattctggagaaaggggagagcctctcatagatgaagttgtgatctacagctttttcaactctgggggcatttgccagttctggccttggattgcagcttgctgggcatagggctcatactggtggatgagaagaaacagcaatgatttgatgatcacacagggctagggtgacacaagggaaatatctgaaacatctcaaattaatggctgatctccctctcaatatataattgatgaattttgaatttgcacagagcatgaggacaaaagctaatatgaaaaaagttgaaaagcagagcttccttttctgcagtcttccagtactaaaaaaaaaaaagacatgctagactactagtttaaaatcctagagagctatatcctaggaacaaggcaatagcagagacagactagattagtcaaaactataacccagcacaagtccgttatgagattaaggtgataattctcccatactttctgtatagcaaagtaaataatgaagactctacggtggaaaagatacttctctttgaaaatactacagttttatacacaatgtatggaattcaatgaaaaatcaataatcatatgaataggcaggcccatgagacctaaaaccaagttttaaaaccaatgccaaaaaccaaaatatataaacagacctacaggtgatttagacgtcagagtttgtagacaaggactttagaatgctatggctaatatattcaagaaaaaaaaaggaagtgattactaaagcagatcaaatacctataattttaacagaaaattggaacctataaagaagaataaattagaattacagggaagtacaatatcttaaattcgaattcaatggatagatttgacaagcagaaggcaggatcagatgactgaaaaattgataaatagaaaaaagcagaactgaaggatagaaagataaatacacaaacaagtaaaaagcgtgtgggtcatagtaagggaatataaatcatcctattataaagacacatgcacacgtatgttcatcgcagcactactcacaatagcaaagacatggaatcaacctaaatgcccatcaataatagactgaataaagaaaatatagtacatatacaccatggaatattctgcagccaccaaaaaagaacgagatcttgtcctttgcagggacatgcatggagctggaggccattatccttagcaagctaacacacgaacagaaaaccaaataccacaagttctcacttataagcaggcgctaaatgatgagaacacatggacacacagaggggaacaccacacactggggtttttggagggtgggaggagacagaagatcaggaaaaataactaatgggtactaatcttaatacctgggtgatgaaataatctgtacaggaaacccccatgacacaggtttacctatgtaacagacctgcacatcctgcatatgtacccctgaacttaaaataaaagttaataaaagaaattgcaatgtgtaatttgcagaggataaacaggcagataaaggagcaaaagcaataattaagtaaaggccagacactttaaaactgatgaaaattatcagcccaaatactcaagaaatcatataaacatgaagcagcataaatagaatgaaaaaatgcttattctaaagtttatatggaaatatttaaagtaacaagaatagttaaggagatcttaaagaatcataaagctgggaaatttacattaaaatctaatctgatatcagatatctagaggtattttgaagttacagtaatttagaaaaggtattattgttgcaaagtagacaaatatactcatggaacagaatagaagagagagagagaacgagagagagagagacagagagagagattcatcttgactcttacatcacatgataaacaaaaataaattccagatggtttccacatctaaatgtgaaagagtgaaagataaaacaatccagcttttattaatagaagaaagcataagagagtatctccatgatcttggaaaaggtagagactgcttacacaggacatagactaacattaaccataaaggtaaaatagaatgacttaaaatatattaaaaattaagaaattttctttattagaagatcattaagagagtgagtagaagccacagagagggagaaagtatttgcattgcatatgcctaacaaaggactcaaaagcataagacatcctgcaaatctatataaaaagtatctgaaacctcgatagaaaaaaggccaaagtctttaataggcacttgttaaaacagtttcccaagctcagaaacacacacacacacaggcacacacacgcacatgcacatgcacacaggcacagacagacacacacacacacagtgactgattgcattagtcagcagggaaatgcaaaataaaatccaaaggctaccagtacacacccattagaatgactaacataaaaaagacagaaaataccacttcttggtgaggatgttgagcaaatctggactctcatgcgctactgataagaatctacgtttgtaccaaggttttggaaaattgtttggtgctatttaatagtgctatacatgtgcatatcatacaactttgcatctctagtcctgagtatagttccaaacaggcatcattgtttatgtataccaaaaggcatataaagaatgtccatagcagagctcattgtaataaactccactgggaactaccttaatgtccatcagaatggattgaaaagctgtagcatagtcacgcaatgaaatactatacagcaatgacaattatattacactcaacaacatggatgaggtacagccacaatgctgagcaaaagccaaacacataagtgtatatagaatctgattctatttatgctatatatacaaacaggcaaaactaatatgtgctgttaaaagtctttaatattttatccatcattgccgttggttgtatttccagattcctgacagattaagcaatgggattcaggaacaagaagttggaattcctaggtattttataaattcaatgttattcttaaaacactttcaaacttcttaacgctctttatccataatcatggatatctaacttttaataaataaaaatattaatagtaactttagaagtattcagaaagagtggtaatatatggaaagattactcagacactggaaaatgatagcaaactgatagtatttgaataacaacatttgaatttcttaataaagtaaacagcactacacagaatcactcatccaaattgccagtttaaggattgattttgcttcttaaacttgttatgtattagaagaacactctcagggtttgtgtatagtatatagtgctttatgcatttagaatactgtgtgtgtagtatactatacatataaaatactatgtgtatagtatacttatgcatatagacttactaatattaaattttcaagaattaccatcagcagcatagagggccattaacacacataataagcaaaatcaactgatcaggttgtgaccactttaatcctatgtacttctgtcctgacaccagagaatttcaaaacttttaactcagtgtgacagtgtttcctgctcttggttttgacttaacatcaatagattccttcaaattagtaaagtctctatgtctattgttaagctttaattcttacaagatgattataatacttttttctggttttgctcatttctcaagtatttttctctggatttgatattcagaaaaatatctatctttctcaacacaatgtcaggaaggagtttccacatagaagcactagtcaggatagtggttacccttgatgagggttgttattggaaagggaagcaaatgatactcctgggtgctgattatctggaatgtaacttcggtgttcataaaagagatctggattggagatttaatttaggtgtcatccacatagatgatgtttaaagccatacaactagatgagatcactatggaaatgactatatacagagaagagaagagaatcaaggaaggactttttctttagacatgataacatttagaagctagaaagaagagaataatttaataaacgtgaaggcgaagacaggtgacgtatgagaaaacctaaagggaacgtgttgtcctggaggccaaataaagtacatcaagaaggagagtgatttaaattattaagttcctaaatgggcagttaaaattaatcttagaaaacctctagtgaggaagcaattctggaatgacagagttagaacttctgaaaatccactcctccataaaagcaatgagacaattttcaaacattgtcaaaataaactttctccaaactccggaaattaacaaaagtctcctaacactctgaagagcgttattcaagaaaaatgattagttctcagtacaaccagggagccctattcccatcctcttctttcctcctctgtagaagccttgaagattttgtcatgatgaaaaggtcaatccatcagaaaaaagtataacaattataaagaaatacacacttaaacacagagccccaaaatacatgaagcaacactgatagaactgaagagaaaaataagacaattcaacagtaataattagagatttcagtattccactttcaatacatggatagaacatctaggcagatcaacacagaaatacaagatttgaacaattctataaaccaattagacataaccaacatctatagagcgttccaccaaacaacataagactgaacattattctcaagtgcacatggaacattttctgaggtagaccatatattaggttatacaataagactcaataaattttaaagtattggaaccatacaaagtacattttcttacccagaattagaaatcagtaagaaaaggaagttcgcaaaatttacaaatatgttgagatcgaacaacacattcccctcctaaacagacaatgatccaaataaaaaatcacaaagggaattagaaaatattttgaaacaaatgaaaatgatgacataacacaccaaaacttatgggatgcatcagcttaaagcagtgcttagagggaaatttataactgtaaaacctatatttaaaagagaaatctaaaatcaataacctgaatttccaccttaagagactagaaaaagaagaccaaactaaatccaaagcaagcagaaggaaaaaataataaatattagagtaaaaataaataaaataaagaattttaaaaattaaagaaaataaaaaaatctaaaagttatttgaaaagatcagcaaaactgataaacctttcaccagacagacgaagcaaataaaagaatagaatcacattactaaaagcctgaaagaaggcacatcatacttgccttacagaaataagcaggattttatgggaatactatgagcaactgtacaccaacaaattaggtaacctagatgaaatgaaaaaaagtcatagaaatatacaaactgatggaactgactgaaggagaaatagaagttttcattgaccctatactaagtaaataggttacattagtaatttaataacttctcataaagaaaagcccaccattagatctaaggcttcaccattgaattgtacaaaacacttgaagaagacttgataccaatcaataccaggttttcacaaataattcttccaaaatatagaaggggaaagaacatttcttaattcattctatgaggccagtgttaccctgatatcaaaaccaaaggtaactaaaaaatacaactataggcaagtatttcttatagacaagtatttcttatgagtatagacacaaaaatcttcagtgaaactctagcaacggattcaagcaacttataaaatggattatacatcatttttaagtgagatttttcccaggaatacaaagttggctcaacaactgaaaaccattcaacctaatatgacatattaataaaatggacaaaaaccacacgatcatctcaatacatgaggaaacatatatactctgcactagaaatccaaaattttcttaatttgccagtaactagtggctataacttgtcctgtcattgtgaataataaaagttttgataattgcaattatttgattaagttataaaccaatatagtaccagtttccatttgcttttatatataccagcctcaggctgtagctttcagattcatcagaactcctaaattttttaaaaattattttcgttttaattgacaaataagtgtgtatactttttgggtacaattagatgtttcaataaatatatatattgtgtaatgatcaaatcagggtatttaacatttccattatcttaaatatttatcgtgtatttgtgatgagaacattcaaaatcctctcttctggctattttgaaatatatcatacaatattttaaaaatataatcagtcttctgcacaatagcacaccagaacttattccttctatccaactgtaccttgtacccattaatcaatctccctccattaaccaagctctctccaggccctctctcttctccttccccagcctcaggtaaccgccattctattctctacttttatgatatatctattttagattatgtatatgaatgatacaatgcaacatttgtctttctgagccttgctcacttcatttaacataatgtcctgcaattttatccacattgccacagataataggatttcattctctttttatggctgaatagcattccattgtgtgtgtgtgtgtgtgtgtgtgtgtgtgtgtgtgtgtgtgtgtgtgtgtgtttatatattatataacattttcttattcattcattcattgatggacacttggattgattccatatcttggctgttttgaacagtgctaaaatagtaattgaagtatagatatctgttgaacatattcactttatttattttgggtgtatacccagtagtggaattgctggatattatggtaattcggtttttaattttttgaggaaactcaatactttttttcatactggcagtaccaatttgcattctcaccaacagtgtataagaaagagttcccctttcttctcatcttttccagcacttgttctcttttgtctttttgataatagtcattctaaccagggtgagatgatatctaattgtggttttgatttgcatctctgtaatgattagcgatattgggcattttttatatacctggaggccatttgtatatcttcttttgagagaagtctattaaggtcttttgcccatttttaaaatcagatttttttatattatttgagttccttagatatactggatattaaccccttatcagatgtatacttcgaaaatatttttcccattctgtgtattttctgttcactctgttgattgtttcacttactctacagaagatttttagtttgataaaattccatatctctactttgcttttaatgcctgtgctttggtattgttatctaaaagatccttgcccagatgactaatggcatggagaatttcccctacattttcttctagtaattttatagcattgggttttacatttaagtcattaatccattttgattccattttttatagtgagagataagggtttagtctcattcttgtacatgtggacatgcagttttctcagcaccatgttgaaaagacaagtgggattcatcccagggatgcaaaaatggttgaaaacatacaaatgaatagatgtgatacatgacatcaacaaaatgaaggacaaaaaacacggtcatttcaatagatgaagaaaataatattcaacatctcttcctgatgaaagctcttaactaattaggtatagaaaaagaatgtacctcaacacaataaaggccatatatgacaaacctacagcaaacatcatactgaatggaaaaggctgagagctcttttctaagatctgaaactgtgaaacaaggcaaggatacccagtctcaccacttctcacaactagtggtgagaagtcctagaggtactagaagtcctagccagagcaattaggcaagagaaagaaataaaaggcatccaaattggaaaggaggaagtcaaattgtccctgtttgcagatgacataatcatataaaaaaatatatatatatatatatccatacacacatacatatatgtgtgtgtatatatatatgtgtgtgtgtgtgtatacatatatccctaaagaactaaacaaaaatttgttagaattaagaaaataagcaacgtggaaggatacaaaatccacatacaaaagtcagtaccatttctatatgccaatagtgaactatttgaaaaaagaaagtgattccatttacaatagctacaaaacaataaaattctaggaataaatttaaccaaggaggtaaaagatctccacaatgaaaactataaacattgattagaaaaatagaggaagacacaaataaatagaaagacgtcttgtgttcatggactggaagaactgatattgttaaaatgttcatgctacctaaagcaatctacacattcaatacgattgctatcaaaacaccaatgacatgcttcctgaaatagaaaaaacattctaaaattcatatgaaaccacaaaagaccccacatctccaaaaccatactgagcaaaaggattaaagctggggacatcacactacctgacttcaaaatataccacgaagctatagtaaccaaaacagcatggtagtggcataaaaactgacacacagaacaatggaacataaaaagacacctacaattgtatgtttatcacagcactattcacaatagcaaagtcatggaatcaacctaaatgtccatcagtggatgactggataaagaaaattgctatatatatatttacaaacacatacacagacaccatggaatactactcagccataaaaaggatgaaatcatggtctgctgcaccatagatggaactagaggccactatcctaagtgatatagctcataaactcgaataccgcatattctcacttataagtgggagccaaataatggatacacatggatacagagagtggaataatacacactggagattccaaaaggtgagagggtatgagggggtgaagattgaaaaaatacctgtagggtgcaatgtttcgtatttgggcaatgggtacactaaaagctcagacttgtccactacacaatatatcagtttaacaaaactgcacttgtactctccaaatctataaaaataaaaaaaaaggaatagagaatacagaaataaacctacatatttacagccaactgatttttgacaaaagcaccaaaatacacattaagggaaggacagtctcttcaacatatggtgctgagaaatctggagaatccttggatttttaccatgtccaaaccaaacttaagttcctttcactaaaactctttgtgatctctatcttggtttatatcctgtattctggttacctacctcctcaatcttatatcatatccctttccccattacattggccttctgccagttcctagaactctttaccacgtagaagactttgcatttgctggttttggggggttgcggaggtttagttgttttgttattattttggcctgaaatgttttccatcaagctcttgcatgactgactccttctcatttcttaatgttttagattagaaaccaccctcagagagatcttctcttaccactgtatctaatgacacccctcctcaccctgtaactctattttcttcatagcatgcatcactctgttactatattatttatttacttgtttattgtcagtcttttctcactagactgtaagctcaatgaggtgatgaggcctcagatgttttatgatcgctgtatcttcactatctaatatgatgccttgatatttgttgaacgggtaactgattaaatcaattaagcaagtggtttctgacaatatttcaaaagaaatgctttctcatttgtgctaacatggcaagattgtttgttacttccttttttcctggggtctgttacataccaaggctcagataacagaaggaggcattttgctaagcaactaaagacaaggagttgcttttgccattatagctcatgaaatatattgaggggcccattcagcgagtgcaaaagttctaattgtcaggtagatatcctttcttcaggaaccagtccctccaccctaccccagctcctctatggaaatagaatgattggaattgagatgagggggcagttttataggagagaagctgaggaattaaaggagcccaaatccgtggaagaaggaaagcagaaggaggtctaactgggaagaattctgctccccagtgggtgaataaattccatcattatccatgtacttggaaaagctacaatgttaggatcatgtagaatctttttaaaatgtcctttttcctttcttaagcaccatgaaaagtcaaaaattataatcatttctacttctgaaatcgctctgtcccactcagttcaacccactgtctagtatattatgcctatgggtcactgacaccaaaaggcattgtgatgaccttttaaatactgtcttggcttcagtttcactcttttccaccagccatccttacggcagctagggtgatccttcccaagcttatatctggtcatgtcatctctctcctttaggcatgtccacaactcgtgtgtacacacatgtatgtacacacgtgcgtattccaacagaggttcccactttcccattagaagtttcttctggggactatataataaaaacaagaaatccaggactgcaaaaacccttagttcttagggtaggcaatttggaatttttttttttttttttttttttttttttttttttttttttttttttgagacaaaggccttgctctattgcctgggctggagtgcagtggttcaatcacagctcactgtagccttgaactcctgggcttaattgattctcctgcctcagcctcctgagcagctggggctacaggcatgtgccaccatgcccagctaatttttaattttttttgcagagacggtttccttctatgttgcccaggttgttctcaaactcttggccccatgcaatcctcctgcattggccttccaaggtgctgggattacaacataagccactgcacccagactaacttggatattttatgctatttattaagcttccttctggcctgtgactccagtgatactattaattcctttaccgctccatgtgctcacatactttttgccttggctatgttgttcttttgctaggaatgtccttctttcacctactaaaggtggcctcatcttctgagtatcatttactttaagaatccttctgtaacaccccactctgagcaggagcaatagtgctcacctctggttttacttaacacttgtgtttattttactagtgtgcatactcctatattccaaattgcactacagccattgtgctttctctgtctccccaagtaaattgtgggcttcctgatgtgatggtggctactgtgccttcacagactttgtttaccagtacaggtcaggctccaagcagacactcaattgagtagttttcaacttgtttttgtttttatttttaaattcacatcttcgtcttccacttattcatgtctttcctgctttgccctctatcttatgagaagagggtatttttttctcctcaaatccctctgttcccatatattattgccaaagaaattaaatcgctgctttttgcatgaagtaaggtgctagtctggagaagtgaattttctgagataccgatagctacacagtttgtcgtcacatctgccttagggtctgcttggattttcagggtgaatattcagtgttgtctgtgccaggtactcaacttaagttaagagatccagcaagaaattccttttcttttttaggggtggaaacaaaatcttccattgcttactctttccctgaacgaacctgttctagtttttacactgccaaaatcttgggtagattggatagaacatggcactatctttaaacaaaaagtgttacaaccatctgaatagcaaaggtaagaagacctatacagatggttccctgcttaggagtaggggtaccccaagcatatgtactaaagataaaagactctggggaaaaatgagagcacaagggtcttgtgaaatcacatttcgcagaccgtgttatgactgcctcatataatatcagtgtaaattttaggtaagggtatgagaagggttctgagaagattttcctttcttcttggtgataatagtttaaaggtccacaaatcaagctgagagccctagatatcccataagtagaagaggatgctttgtttttaaggtggaattataaggaatcatagccatctataggagaaagtctctagaccataggttataaattgggagcttcaggtgtgacttgtttgatccatacacagtttacaacttttaaaattatttgctaagattttaaatttgtgagatgtcatataaaattccacatttgcttattatttcacaaaatcagaagactgacaacacactgggctcaaatcctacatggcttcaatcaatcgaggccaaatagtgaccatcccttgtagatgagggtatgctttccctttcctcataacctccatcactttcaccttgctccctgaaaagggagtatagtatcagttgccagtaatcatctcacttgcacttttgttttacttacaagagaattaagagctcccagtagaaatgaggaaaatgaaagcgttcttgtaccatatctatcaatttttttaaaaaattaagacatgctgagatggctatattttaaacaagatgggagaatttacattttcttatagaaataaaggatattttcacatctttaagcacacaaagtatgcttttgttgaaaacaaaacttcatatatcaaaattatgctattcattacaaaaaactatgatttatatatagaaaaaatgcacaatgaaaatattaattaaaaaacattgaaagttaggttttgcgcttcaatgcatacactaaatgttattgctagaaaatgtggttatgctttcagcaacaaacctttataggcatcaaaatatttcatagataccaaacttgtaaaaaaaagtctattaattgtatcagaaattatgtgtccaactagaaatcttgttgttgttgtgttgaagaaatgactgagactatatacaaggcaaattatgtggaaaagttaaacttcctgtgatattttcctttgcagcttatgagagcacagatataaaaaataccatagagttatgaatatttgttcatgatgtcagtgagaattttgatgtgattggagaaatttttagcatgttgctcattacaaacaaagcaggaaatgacttatttaggtgtattgaaaaagttttaaaaagtgtaatgtaagcagatcacaattggtacccatgaatagctgttaatgtcagacttgtgaaatgtatatccaatgttgcaaagttttgcagggacccagcatttatatttgtttattggcagattcaccagaaattatttgctttgtggtagaaggtttcaatagagtatattaggggtatagtagttgccaccatgagctggaggaacccctcttcccctctggcttgaacaacaggcagctcaaaacttgaaggaaaagggtatacagtatgcggtcagcttccctttatgagcctgggtgcctgagttagggcaagtactcaccctagatataaaatccacggtggaaagagttaaccatgtcagggaaggaatcaactcatttctttaatatactgactaaagttaaataaccccacctcatttctgaccatttcccttactcacgcccctgttaatctatacaaattctgtacttgacattggaattctaaatacaagccttgacattaatgctgatgcaaaagaaaaggtgtcaggtaggtgtcttgtttgcatatcaaactgataataagttatgaaagaaaatcaattattgtaattttaatttggaatttttcttttttaacttaaaatatcactagtttgaatttttgctttctctgatatgctcaccccataattaattgaatttgtactacttttctgccagcttatttttcttataattagcctcatttacttattcaaggtacctctgtgttagtctgttttgctttgctgtgaaggaatacctgaagctaggtaaattataaagaaaagagttttatttggttcatggttatggggggctgtacaagaagcatggagccagcatctgcattttgtaaggacctcaggaagcttttactcatggtgaaaggcaaagcaagccagcgtgtcacatgaaaagagggagcaaaagagagaaggcggtgcaaggctcgttgaaaacaatcagatagcctgtgaactaatacagcaagaattcactcattactggaggggggtgtcaccaagccatttgtgaggaatctgcctccatgactcaaacacctcccactgcaccccacttccaacactggggtttgcattttaacataagaattggaggggtcgaatatccaaattttgtcaacctctatggctcctgtaggcatttgagtctgtgacatctacatgagataatattttagccattcctccccctgcccctactgtctactgtccaacagaagaaaaagtttattggcagtctagaagacagtcattgaagtatgagaacactttgggttcatttctatgtacacagcatatactacagtagctgttcaatgagagtttattgtatggatggatggatggatggacggatggatggacttcagttgaagacagaccacatacccagaactctttgaagatggaagttttatttcgatctcatttgagtttagtatcaagggtaatcattctccatttccttcaacttctctttattgacccttctctgccttagatgcctatacaacagctgaagtggtttattcttggactctcggaaagaacaaatccgtggaagtggcacaggatggttctcgcttgaaccagtatgaccttttgggccatgttgttgggacagagataatccggtctagtacaggtatttaacttattttatttaacaaacatttctgtaacctataccacatgccagtcactgttctaagtgcttataacttacttaatcttcaaaacaatgttgtgacaaagatagtattatcatgagaaaactgagtatataaaagttcagtaatttgctccttgtcacagttatgcaatggcaaaacgaaaatgaacacttgtcagattggctcccaagaccatcctcttaaccacgattgcctgctgcctcttgaagagtggtgcagaaggtgaagggcattagggctagagtatgagaagagaaagcagatgaaggccatggtgggggaagagctgagctttgttcctaaagatttcattaaaataattgcttaactcagcctgtgctgaggtggcacattaactaatcccagaaaaggtcaagcacacagccaggatgcccagggagtagccatggaattattttcttaaggggatcacgtaactcagaaaaaagcttggttggcaaaacctgctaggttttatcaatggctaactcttggatattgacaaatgaaactagagttttgttctgtggccttaagtctgtccatttggaaatggcccctgagcagttcaaggggcctgagggacgatatattctggatctcaactaaccttagaatgttcgtcaaaatggagtatatgctggggcccacatatcacataatattttttttgctatgaaatgatagaagctttcaacgttaattttcaagcaacacttgtctctgtgaatccacaattatacatgtccttttatctcattatctagacatacactgttccctcttgtgatatcacagtctgtcatctcctctgccccctgttttccctccacctcagaatcaggggagggtgcctaaaaaaatcaacatttgaaatggaattgaaggacaaacaggatttagagatctagaattagtgtggggaaaggctattcttgacaaaggcaatactgagatgtcgaaagtccagaagtatgagagagcatggcctgttagggaagctgaaagctgttcagagtaagatgcagaagagataaggagtgtagggctgcaggggtgggtgggctgttctgtggggtcctggcgtcatgtatggcaggcctccggctggaccagtccaagtggcacaggcaggcaaggtgtggctggccctaatctgaagaattccctccttccagtgggtgagcattgctgctggggtcaagtgcctggctttggcagaagcagtagaggtagccggtggtgggagtgtctgggccacctgggccctgtccctgtgtcccaggagcgctcctggccatcgtgcattggctacctgggccactgcgtggccagggctcagagcactgggagtgtgggcagagccagacagggacccgtccctggctcactgtgctgaaggtgaagcaggggcattgacatacttttcctgcactggctgcacaggtactgccagcctctttagagccctgatcccgggactatgcaagcaaggagggagaggagccatttgcaggtttcacacaccctcctgtcccctcacgtctccactggaccccttacatgtgtgagcagagaagccggcctcctgcttcaagaggtgccaccaccaatgccactgcctggtttcccctcccttccccaccccaacttaagggaaaagagggggccccaggaggaggctgaggctgcagcatcacgtggcccaaagtggtgcactgcacagctgggccctagaggctgaaggcccacccttgctgctgcagggatttcctcctcagagtgagcaagcaagagaagtccctgtatctgttcactcccctcacctccccgtctgtcctgggcactgcccacctggcatcaactcttgagaccaatccttggctgcccaatcagaccccactcccacttcattttggtaaaccgcggttggtgtcatctttagcacacagaagatacacgttcataacaggaaaattagaaatacatggaggagcaaatgttggaaattaaaattctttttgtttccactttctagaaatatcttagaagatttcggtacattaactgattgttttacattcagtatttaagacggttccctttgcattttctgtataaatatgtttttatgtaaatggggccatagtattgatacttttttataagctgatttttatttaattttatattataaatgtgttttcatgtcactaaatgcacataatccaggtaaaatgtacacaagatttagtaaaatatgttagcaattagaatgaacacaccacacatttattattacttgttttggttacttaaaaaaaagtgaaaagccttcctgtcaggccagagcatagttgacaatgatgataatccctgttgtcactaggaagtgtagcatttcattgtgaaactcagtaaaatagtatctcttttttggtaatgtcctcatatagatggatcacaatctatttaaacaatcatccactattatattctgtgttttaatgctataaacaacactgtaaagacccttcttttccctatagcattttgctcctgtttaagtatccgcctaagatacagacaggatattgagattgctatttcagaaagtagacacattaaaaaaaattgatacatattgacaaactgctgttctgaaaggttaaacaattcacactcctattatcagtgatgagcaagccaatttcccctcactcttgccaacacaggtatcatgggttgaattgtgtcccctgaaaagatatgtttaagtcctaatccccagtactgcaaaatgtgaccttatttggaaacagggtcactgcagatgtaattagttaagataaggtcatactgcagtggagtgggccctaatccaatttgactggtgtccttataaaaaggggaaatttgaacatagagacacacacacacgcgtgcgtgcacatggagaacaccatgtgaatatgaaggcagagattggggcgatgcttctataagttgagaaacagcaaagattgtgagaaaacaatttgaaactaagaagaggcaaggaaggatttccctacaattttcagagggagtgtagctctgctgacacctcagtatcagacttccagcctccagaactgtgaaagaatacatttgttttgttttaacccatccagggtgtagtactttgttatggcagccctaggaaaataatgcaacaagatattgtcattcttgttttcttactgtttatcaaagtaatatatgggtttagtggtagaattactaatgatcaatttttgagcatgtaatatgtgcaaagcatttccctgagggcatgtattaactcacttaacccttgaacaacagtttgaggtgggtggtggtattatctgaggtttatagataaggaaatcgaggctcagacagattaaataattttctcagggtcacacagttggtaagtggtagagcaagatttggaaacaaggcagcaaacttgctccagagtctataaacataataactacatggatcactccctttctactttgcatctagaaggaaggaggatgtaaggaaagaaggaaggcaggaagaaaggcagggagggagggaaggaggaaagaaaagaaaatttaaaaatcaaataacaggtatatactgaaaaggagcagttcccattttaaccacttatgttttacttctgatggttccctccatagttctaaataatgtgcttatactgccatttttcacctttagagatgaaatattgattccctactctaaggtattgagtgcttatctcacttccattgcccctacctctcctttcctcctagtattgatagctggatcaaatagttagctatatttattgatctatcaacccttctgtcctcatatcctcaccttctttcttccaacttctgccaactaaaagtttgctttcattgtaaaaacggattaaaatatacactcagttcttgcggtagggagaatagcggccccccaaagatgtccacattctattccgtagaacctgtgaacatgttaggttacatggaaaggggggattaaggtgcctaatcagctgatttcaaaatagattattctggattattcaagtgggcataatgtaaccatgagagtccttataaaggagaggcaggaagaccagagtcaaaaagaaaatgagtagaagatattttacagctggcttgaaagatgacaaatggggccacaagcccagaaatgtggactacccagagaagccaaaaaggcgagaaaacctattcttccctagagtcaccagaagtgaaggcagccccacctacatcctgattttagcacagtgagacccattttagacttctgaccttcggaagtataagagtataaattcgtgctgtttgaagccaacaagtgtggggtaatttgataaagtaccaataaatagaaaactaatactgttatatacccctaattaagctttcaatactttctctatagattgatttaaaaagctcaaaaccagcaagggacatttgtattactatgactgtatgaatactatcttttgttgggattgcatttcttgtttaagggcctaccacccacttaaatttccctagttttctgtagaaagacccttcagagtattttagataaaggcactcagattatctttcttttgactgggagagtaaacacactgatacagtcattgtgcctatggaagtagggcttgtaacttttccaagttcagatctgcaggaaatgtccctattttccattcccattcttgagaccctctccctttgtccctgcagcctccaggtctgtgtcctctctgggcattgccagcagggacctcccttgtaagctgagctccctctgctgcttctcatctacactgaggcctgctttctccatcagcactttctgaattccaaaattctcttgagctctttcattcattctttcctgttgttttctttcttatgggtttattctattttactgtcttcactggtacttgatgaagtcttaagagaaagaggaggtaaatgttgctgctcagtctgctatatgaattggacatctttccaactttttacctacattttttaggagctgcattatttccatttttaaaatttacatctcgaatataatctggagttttatttttggttttgctctatgaggtaaccaaatgtaccagtatccacgagtgaataatcgagtgtttcctcattgatatgagatgcttcttttatcatatagtaaattcacatgtgtgcacatacatacacatacaaacgcataaatgtgtgtctatatttattattctttttcattgttgtctctctattctttatatgtatcacattattttaattatcgaagatacgtgttttcaaactgtgtatatatacacacacacacataatctttctaggaagatacacaagaggctgttaattgtagttacctaaaggaaggagatgtgaaatgggtaatttggggcagatgtgggagggagacattttgctgcacacacttttatacctattgatttaggaaccatataaacattattaccttacatatatatgtattgtttttattgtgaccataaattatgggcattcctttctaaattcttcatacactcttccatgtagggtctagaatatgaatggaaatctgggccagagaaaggacccacaatccgtggatgttctgattggtatggctggctttctctccaaatgctgtcagtcctcagtatgaactagcttcatgcagaggccgtctgctctttgctccagattcaaacatgtattaaataaatgaatgaaattcctcaaagtctgtggctagttgttgacaccatcccctgttttccctaatttggcgaattattacattaattttctaaaaggatagtttggatgtatgatccttatatatccatctttcctagaaatttgatcatttgttagaatgacagttttattattattgtcattgtatatattatttctttagatgtgtagcataggtaagtaaagataaggcataaaacaggacataaagaaaaatcagagagatggagataaaaagaaaacaggaggcaagataaagaacaaggagtagagatagagagagggaaaaatacccaagatagatttaagaaaatatatccacttacttttttatgatgacttaatttgccaagctaaaaaatcctctgtgtgtttcaaaaccttagaaactagctaagttgtgaatgtgttttacattctattatcaaatatttcatatttaacacagatggagtttaataggctgaagtgcaaaggcaggagaaaattcccccaaatcacttaaagggccatccttcataataagaaagacagagagacacagcaataggggcaaggagggagagaatctaacaaatccacttcaggaaaatatagtcagttacgtaaaacattatttagctaaactgttctgcgtttctgatacatagataataactaatttatgaatacatatgcattgtgtgttttatattgtacccttgaatatttcatatacaacacacacaacacaggtggtacataatgagcttaataagctgggacaaaagggtggaggtgggatggagggaattgtgaaaatcttccaatttgattaaagtttcagttctctctttggcagagaagaagatatatagagatggaaaatatcagagttgtgtttaagaaaactgattaagttaattgacataataaattaatttgctaagctttctaaaagtccacttgtaagttccacccatagaaatgatctaagttgtgaatactcgtgaatatacaaaagtgtctttccattgtccctttgacaatttcacactggacccggatagcctccaatacaaggacagaaaccagggaaatcttcgcaacctaggtgtcagttcttactaaagagaattcctttcacctcttcagaagacagacaacaagacagaatgagaaagaaagaagtatagaaaaggagaggattgaggaaaatcaatgtgttcaaccattttgagtcagttattcaaaacaaatggttaatttggtactcttttgaaaagtccatttgctttgccttttagatccacagaatgtaattaatttatgaatatttattacatcttttatatattaaatatttcacatgatcagagataggattaataggtagcgtttggaaatgtgagatggtaaagagggagaattgcataagctcatcaaagtccaactctcatgaaaaacaaatccccaatgccttctcagtggggagagagtgaaggaaagggaaaggacggaaagaagtagagatgcacacagacagaagataaaacaaagaaagaaaagaattgaaaaaaagaagcagagagaaagaaaagagatgggaactccaaagttgtaattttcaatttgctaaattaaaaataagcctacttgtattttttgtgttcacataaacaagctaagatgtgaatacatattcaataagggttgtatattgagccttggatgaccagatggtgcttcctaggtttaggtacaagggagtgggtagagtagaaaagtgggaaattgcctcacttgggaatcctgccaaaaccaaatgtgggtggaggaagagaggtgaaaaataagaagctctgataagagtgctattagagcaggcatatcgcaagggtctttggggactattttggggaatctggcttttactctttgagagatggtaaaccattggatagttttgaacagaagacagacaagatctgacttacgttttaataagatgatttctggcagctgtactatgaatgcattgaagaggagtcaaggacagagcaaggagaccagttagaaagctattatagtactctaggtgagacatgatggtggcttagaccagggtggtagcagtagaagtggtgagaagtggtcaaattatggaaatattttggagaaagaactggaagagttggctgattgattgattttgtgtgtgttatgtgtgtgtgtgtaaatgtgagacagaaaggagggagggaaggagagcaagtgagagagagagcaacagaacacggtggggttgagaagtcagtggaaagtctcttgggggagccattttgaatgggtgttggggatggggagagtgaaaaccaaaatcttgatttttcatgttaagtcaagatgcctattagatccccaagtagtgatgtctaatatataaatcttagagttgagtagagaatcttaaggctcctataataaagtaccacaaactgtgcaacttaacagaaatgtgtctcacagttaaggctagaagtctcaaatcaaagcatcaagaaggttagttctttcgagattctgaggggaaaaatctgtcccttgcctctccctagtttctggtggtggctgtaatctttggcattccttggcttgcagctgcaccactccaacctctgcttgttttttgctttttttatttttttttttttgagacagagtctcgcctgttgcccaggctggagtgcagtggcacgaccttggctcactgccagctccgcctcctgggttcacgccattctcctgcctcagcctccctagtatctgggactacaggtgcccgccaccacacccggctaatattttgtatttttagtagagatggggtttcaccatgttagccaggatggtctcgatctcctgacctcgtaatctgcccgccttggcctcccaaagtgctgggattacaggcaggcttgagccaccgcacccagccctctgcctgctttttacgtatccttctccctgtgtgtctgtgttttcacatggtgctctcttctaaggacactagtcgtgttggatgaggggcccaccctactccagtacggcatgacctcatcttaactaactacatctgcaataacactatttccaaacaaggccacagtctgtggtaacaggggctaaggcttcagcatatctttttgagggacacaattcaacccataacaagtaggaagcccaggtagaagttatacattggggagttattagagtttaaggtattaaagacacaggctggatgagaattgccagcgtctgagtgagacagaaaaaagaagtgcaagtacagagctttgacatcctccagtgtttagaaattaaaaggaacaggaaaggagacttaggaggaatggtctgtgaagtaggagagaaaccagaaaagcatcatggcctagagggtctgtgaagagagtgattacaagagggaagaaggatcaactgcataaaatgctgctgacaaatccagtaagagggagaattgactaatacatttagcaatatggggtaattattagtacctatctcacagaactgttaggaggatataaagttaacaatccacaaacactcagaaaatattttggcacacagtaaaagcgcagtaagtgctcactcttattttaggagtgggataacgtaggtcagtccacattctgctatgtgaacttttgggtctaaccaagtaagtacattagaacagcggagcataatggttaaaaagcataaactgtggacaacctacctgggcttgactttgggctttactaattactagctgtgtaaccttatgcaagttgctccatctctccttgcctcagtttcttgagctataaaatgaggataacaatagtacctacctcatagggctcctgtgaagattaaatattttataatgttaaagtgctaaatgagtgcctatcacatagcaagtgctgtagaagagatttttattttattattatttaaatgagaacattaatttacttgaatgaattgtgtcaaaattgttccgagcaagctgtattggtacactgatagcattgttttttcacacacacacaaaaaacacactattttgtgattattaaagggctctagttatatgaacttgggagatgctggaatattgaatataagattaaagagctttgtgaattgaattggggcccaacttgatttagcaatgtttatgtagctacatactgcctaattttactctctctttaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgagtgataatttatggagcgtaggggaaagtcttatcatgcagagtcacagtggaggtgagaaaggtggaagaatggctcctggagagaatgggagaaattcctgtgcctagcaggagtaactgaatcatcagaccatggggttttagacgactgaattctcaaggaggaagttagaataagaagactgttggaccagtaagatactgaaatgcttcccatttcagtcctgcttgccccaaaagctggagagggaattatcctttagtaaaaaagagaggaatttagtgcatagagtggagaagttaaagggttagaaaccaagctgtctgaacagagtattggattgggggctttgttaagatctgctttttttgtatgagcgtttgactttgtggcttcttctctagcctttttgaaagtatgagttatctgatattgtgtaaaggccacacacagtttaaaggatttcttaatagtacccacgatcaaagccattttcttcatcatgagtatactgatgtctaggaagacatttgcatatcattagcactttttcctcacagacttaaaacatacaaaacatttcctgcctatttttcccactgtcggagataaatattaattttttcagctactaaactggcctccatggcaatgatacctttgaggcatatacttgagtgtacttggtatccacacagaaggtgtttctaccaatatcctgaagttttactgggaagtgaaataaaaagtaaattatgttttggaagaagtagcattgtaggtcaggtattgtaggagatagcagtggagaaagagaaatagtgacctgtaaagtaggaaaaagaaagaataatcaaaaggatgtgatatcatggaagtcatgtgaggagagtatttcaagaagcagagaatactcatgtgggttgaactgtactgagtttacatgagatgcagacagaaactgtctgttgggtattgtgatatacttggctgttagggatcttgagaagaacagttctagtgaagtggagggagcagaagctgtatgagagtgggttaaatatgctcactttgggaaatgtaacaaactagataccctgaaaaagcttcctttataaaatcctagaaaagctagataaaacatagaaaccattctttttcatttttccttccttcttccttccttccttcctttctttctttctttttttttttttctttttttttgagacggagtttcactcttgttgcccaggctggagttcaatagagcgttctcggctcactgcaaccccccgcctctcaggttcaagcgattctcctgcctcagcctcccgagtagctgggattacaggcacccaccaccacgcctggctattttttttttttttttgtatttttagtagagacagggtttcaacatgttggccaggctggtctccaactcctgactttttagatgatccgcccatctcagcctcccaaagtgctgggattacaggtgtgagccacagcacccggccgaaaccattcttttaagctaatgtcttaacgtgagcttaaaagaaattaaaggaaatacacaggggcccaaatgaaagaagaaactgaaaattgagtgtcaatcccattaactgtactgttatggcaggaagataagcagatggactcctggtcttggtaaacaagagtttgactttttaaagaaaggcatttacaactaagattgtggtaggcagaataacggtccccaaagatacccatattctagtccctggaacttgggagtgtgacctatacagcaaaaataactttgtagttgtgattaaataaaagatcttgagatggagagattattctgaattatctggaatggggcctaaatgcaatcacagtatccttataagaatcaggcagaaggagatttgactatggaggagaaagcaatgtgatgacagaaggaggaaagatttgaacatgctctgctgtcggatttgaagaaagaggaaggggatcatgagtgaaggaatccgtcatacagctctagaagctgaaaaaggtaatagattattcctttagagcctccagagggagtgcaaccctgctgacaccttgacactggaccagtgaaactaatttcagccttctagcatcaagaattgtaagaaggcatttaattgttttaggcaactaaatttttgataatttgttacataaaccaaaggaaattaatacaaggacacttcccatgaattcaatatcattgaacagttacgctttcaatgcaagggagtactagaaaaatacacttactagtgcagagagacaataaagaagcatgttttttttggcctgggctttgtgtgaaatatgagattccttgataattcatttgctaattcaaacttggcctcacattaatttagaatttatatttacattaattgcattgatgtgagaacctgcatgttaaaatgtttatataaaaaatgattgcagaattgtttatgtaagaaaaaaagcaagaatagccaatatatccttctaaaaaagaacaaagtagacagaccgggagtggcagctcatgcctgtaatcccagcactttaagaggctgaaatgggagtactgcttgagcctaggagttcaagaccagcctgggaaacatagggagacctcttcttaaattttttctttttaattagccagacgtggtggcacatccctgtggtcccagatacttgggaggctgaggtgagaggattgcttgggcctgggaggttgaggctgccatgagccatgatcatgccactgcactccagcctgggtgacagagtgagaccctgtctcaaaagatttttaaagaaaataagaaagcctaaaatacagccatatatatggaaacttgatttatgataaagatggcactgcagagaattaatttgagattgatcatggatttaagtataaaagttaaaaatatgattatcttagaagaaaatataaggcaatatctgtgcaccctttggtagacagaaattccttagttcacaaaaacataataacaataaggaaaagaactaataaattggacttcatcaaaattaaaaatttctgctcatcaaaggataacattaagataatgaaatggcaaaccatatcctgagataaagcacactatatctgtgcagacctaaaaaaatattttgaaatatttatatattctgaaaatataaaaagctcctaaaattcaataataaaaggacaaagaatccaatttttaaaatgggcaaaagatgtaaacagatatttcaccgaagaatatatacaaatgcccataatcatgtaaaaggatccttaacatcatctttttttaaattagggaaatgtaaactaaaacctcatggagacatcactttaaatactagaatggctaaaataagcactgaatgtatgaaatggtaacagtggcttattggttaaacaatacatttagaataaaatactagaacataatgtaatatatatctgttgagatgggggtatatggagataaaatgttccaaggactttcactgtcagagaaaagtgttaaagtatcaattaacgttatttattttattttattttttgaggcgggtctcaccctgttgcccaggctggagtgcagtggtgctatctcggctcattgcaacctctgcctcctggattcaagcaattctcctgcctcagcctcccgagtagctgggactacaggcgtgtgccaccatgcctagttaatttttgtatttttagttgagatggggtttcaccatgttggccaggctggtctcaaactcctgaccttgtgatccacccgcctcagcctcccaaagggctgggattccaggcgggagccaccacgcccggcctaaagttattatattatattttatttcttaagtcaaggatgcatgctgactgaaactctcataaatctactgggaatgttaaatggtaaaattactttagaaaacagtttggcaatgccatataaagttaaatatatgcttactatataatcttgtagttccattctttaggtattaaccaagagaaatgaaagcatatactcacccagacttatatgtaaatcatcccagtatctttattcacaatagttgaacactggaaacaatccagatacccattactgggtgaatgaataaacaaattaggtaatatcaatacaatggaatgctgctgtgaaattaacaggaacgagccatagatagatgcaacaacatgaatgaacctaaaaatatgctgagtggaggaagccagacacaagtgagtacatactgtaaaatatttatacgaaactctaagagaaaaatctaatccatagaaaatgaaagcacatcagtggttacctaagaccaaggaggggatggcatgggcacaaaggaatctttggggagatgggaatattctatagatgatacttatgagaaagggcagaaaggggtatcaccagatggtagatgtctcaaaagagctcaggttacaacaacactgtgatccggtaatggtctaagaagcgctagacatcaaagaaaatatggattgcacttcttgagctcttgattctgaattatcaaccacattttgagaaccaaaacagtgtattcaagaggagagtcaggtttcagttaagaccaaaagggggttatgcattcagagaagaggttgagaaaataggtggactcaccagttatacagtagcagagttgggcagtaagaagagtttgcgataaagggttcataagtatatgggtgataaggtcagataggactttgtaaaacagaattaagcctgactgaaagtgaattaacaaatatccttgcccttgtggtagtgtctgaggtaaacagatatatgaaatgtgattaattctgattatctcctaaggggagggagaatgggtgctcattttgaatgctgtggtctgaaatatctaaattttttatctttagggcttaactctgtataaggcacaaaacagttagcagtgttggagaaaagaagacaataagagctacattaataataataataatatatttaataattaccgtaagaaaagaacattattaactctgataggaacaaatgtggtacagtgggctacttggctgtgcctgagaattaaagtcctttccactcatcacagatgtggtttggtataagagacacatgtcatcacgtaagtgcactagaagtgctcaaaggagacgagggaggacagtcagttctacctaagccttttcagaaatgttttctagtcttgaaagagaagcactggtgacaggctgaatatcttttaaaatgccaagaatctctttgtccatccatgaagcgtaccaaaggcttgattgagggccctaccagctctgactagctaagagctttcaaaaagttgacagttttaattaagccctagagactagagctccaaaaatctctactgagatatggcacagaaacacttatgttgcaatacagttctctccatctaagcactagcagcacactgctatgaatgtgtcagagtggacaactgcatttgctaataaccattaataaagtagcttgtttctcccattaagtaactacttggttggtatgatctgaaggttttcaaggcctggatccattgtcagagattaccaggttacagattcagagagtttgttaataagtattagctatgtggcagattcctcacatggcgtaaaatgtgtttcggctaatcagccttgatgactccctgcctagttggtgcaaaggtactcctttagggtatttctgttgaaattgtacggagtcttttgcagtctggattttcatttatatagcaaatatataagtaaggtactacggcagaccaagatagaaaaggaagccccagaggcttcagcacacatggctgaccctctgggtaaagttaatggacacagtgccttctctgcttgatttcgcatatagcctctttcacctcattagaaattcattccatgccccacttgacccaggctaaggaggctcactttctccatcctcttcagcatgccaacgctaagaaagacattctgaccatttccccttcctcaagtttgaatgactttgtacatctactgctttatcaaaatcctgggggacagagacagtagggaatattcatagatgggcaaaatggaggcacagagagaataaagaaattgcctaagatataaatcaagtaagtgggagcactcagaacatctaacttctagtgtagtactcattgagactagaaaaacatcactagcaattgtaaaattattatgataatattgttgttaacattgattatacttatactattataattatatagtatgacaacactattgttctaacaacagtaaagacaatagtcatgttaattatagaagctactatttatggaatgattactctgtgtcaggtattatactatagactttatgtatatgtgtatatatatacataatcttcaatccctaacaaatctctgtattatctggtgttattaccccccttttacacatgataaactgaggctctctggggtaaaacaccttattcaaggtcatattactagtaggtgaggttgctcagttttcagcctagttcattctgactctaaagcttataccgttaatcacaattttatattatatatatatatatattcacatgcatatctaaaatatgaaaagattagaaaaaatgtaaaatataatttaaatgtaaataaagccttgaatttagaataacactccccccaaaaaagaatcaattggtctaaagacaagcttggatttggcaaaaactcacaagaaacagatttcggaatagttttcatcgttcacaaagcccaatagggacctagtgtgtgacgcagctacagaaccactttccacgatagtttgctgcattatcagaagactgtccaaaattaaggaagtaagcatcttactgaattccgaccatgtcctgagtcttgggctcagttctgggctattcagaaaagaaaaaaaaagaaaaaagaaaaaaaaataggttagggaaggaagtaaacaagaaaaggagttcatgaggtgaacttgaatctccatgttcattctgaagatgagcagtttcgcaaggagccatcaccctttttaggtctctgaaggtctgttctggagagtaaggagcagattttttttcccttgcatggctacagaagacactccaagatcggtctgtggaccagtagctagaagaagccagatttcagttcgtgagctagtttttttttttctaattaaaatgctctcttacaatgaaatggactacctgctctttaatggaaatgtttaagcagaagctagaggacaacaattaaatgtaatccattgcagatgcctatatagtcttctgccaattgggatgggctggttactaggtggacccatcagatttgatagtccagtgtttttttaaaattttattttattttaaaagggccattttgagtggggtaaagcttctcctttcaaataggaaattagtgatttcatcgaataagctctcaatgtcttccagttgcaactggttctcatctttcctctcctcaggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaaggtgagatatagcaaaagagaaactgagaagcacccccgagagacctgtattgggaccaggagtgggcagcctatagcctgcaagaactgggcagggctatgtgctatgcactggggtcatcaatccagttctcaactggagtgcttcttggcaacctggcatgttgtctgagggcaaagaaaagagggcaggtatcatggagggttgatgtcttgtggtgaaggatcaaacctaaatgtgatgctgctagactcaaggggcacccattggtacttacaaagtcactcaaaggcttggactctatcttcaacccagagtacaatctctaaggccatctctgcccctcttcccagtatattcaaattacagtcaaaacaaaatgatcatctttctttctgtgtctgcttattttgctttctgtacctggaatgctctttgttttttcccatgcctgttaaagacctactcattcttcaagtcccaactgaaatgctactttctccatagagcctttctggaatcattcacagatttatctttgattgaggcatgggtgctcctgatattaaaataatttattcatattagtttttgtcttcctctcactagactgtgaacattttgagggcaagagcttgtctgcctcttatttctagctagccaacatccttgcctagcatctgactcacagtaaaagctgaataaatgttgattggattggtgcattgatgggaaggaagaagagagattaaaatcattaaaccaactaaattgataggaataaaacatgaatacagtgaaattaagattgttgtccctggctgctttaaataagttcaggtcgctagaactagatgaagattatcaaaatatgctaagaggaactggcaaatgtgatctcaggaccatcctggtactcctcaaataatcatggagaagagaaacgataatgatttttcaaattaggagaaaatatgtattgcatagagtatagattggtgagttggcaaaatttttgaacaatttttaactatttagataaaatttattaactccttgctataaattatgaagagataagtgtagttctacttccttaatctactctaccataggattttttgcttggttttattgtgcttaatctagttgttacttttgtacccttaaaatatatttattcctctataacttggtttatcagctaggaacagggtctgttagccccccacccaggaagaatataaggaaatcagtacatgcccactcctacctctccttctctctaccagttcctatcatctcctaatttctgtttgctatactactattgctcccttattacattttataacacttacatcctcccatgcaactgtaaatcctataattgtttagtcatagttctacatttaaatgggttcttttcttaaaatcgtccttttatctatcatttctattcattgtatatttacatcaattcctttttttaagttcaggggtacaagtgcaggtttgttatataggtaaacttgtgtcatgggggttggctgtatgctgtacagattattttatcacccagatattaaacctagtattcatgagttatttttaatgatcctctccctccttcttccccccaccttcccaaaggccccagtgtgtgtagctatcttctataagtttctttaagatggtctcatgggaaccatatttccttctgttttgaatgtataaaatcattgtctattgtgtttatacttaaataatagttgagctattgtacaatccatgggtcacattctctttttctgatgactccattaagacatttattacaatactcaataggtcattttcttccttttgtaacaaagtttgtgttaatcgcatgatagtttgtcttcaattcttacttgaagttgcattagagaaatttttactactcttgttatgtatggaaatatcattgggggagtaactgagagagttagcaggatagtaatgagtagctgagaatgagtagtagagtagtttgagcatcacttgttgtctatataatctcttatgagtagtcttccttgtagttgtgattctacttctgactagtaagaactttcccttgttcacaggaaatccctctatgttgatacaggtgtctgtgtgcatgtctctgtgtgtgtttgtgtatgtgcttgtgcatgtgtatgcgtgtatagtattatattctttaattttgcagtctctgtctcctctgccactatgtggtagtcagagttccaggatgttctcattaccagtttgaaaactgattttatttcaaaacagggattgtttctttcctttgtcaggtcatgccacacacttttgggacactatccttgacctgaaatctagagcagcaggtatcctcagtgtcatcttcaccctgatctgattttcactgcgcttcactttcacttcacttccgagcccttacttcttgggattaaggttataaaagctgttaagtttcaccaaagatagagttctggtttttatttctcatcttactgtttttggttggttgcagagaggaaaagtgaacaaaggtatccttactctgacatattaaactggaagttccctaaaatacattattaaacagatagatattttaggagcagttagcagcaatcagtgatatacagcttgagttcactaatgagaaattatctaacctcatgagcatttgtcaacagtttattggactagtggaccagaaaatgtcatagattttaataaaatatttgactaacttttaaaaaattatacctccttgaagaaaaggaagcaggctggatgtggtggctcacgaagcgggcagactgctttagctcaggaatttgagaccagcctgggcaacatggtaaaatcccgtctctacaaaaaaaattaataattatctgggcatgggtgcatatgcctgtagtcccaactagtcaggagggtgaggtgggaggttcatctgagcttgggaagttcggactgcagtgagccaaggtcgcaccactgcactccagcctgggtgacagagtaagacgctgtcaaataaaaaaaagaagagagagagaagagagagagagagagataaaggaaggaaggaagggagggaggcaaaaaaaaaatagtacaattaggctgatgtagttggttgaccaattcaaatcaaatagaattaactgatggcgctgaaggcgatggctcacacctgtaatcccgacagtttgggaggccaaagcaggcagatcacttgaggtctggagttcaagaccagcctggccaacatggcggaaccccatctctacaaaaatacaaaaaattagctgggcacggtagcatgctacttgggaggctgagacgggagaatcacttgaacctgggaggtggaggttgcagtgagtcgagattgcaccactgcactccagcctgggcaacagacagagactcggtctctaaataaataaataaataaataaataaacaattaaataaattgactgatggactgacagacaccaaactgaatggaggtccctggggttacactacaggactttgtctttgaccctgctttttcaaatgttgttattaatgactcagatgaagacatatagggtagaagactcaaatttataagctggtattaatgaatattggttggggaatgagtattttctgaattaggaatcaaagaggatttctaaatttgaaaggacaagcttaaattaaaatattaacatttgctaaatcaaatacagattcttacacataggtacaaaaaaatagacctgggattaaaaaagcttaacaattaaacattgaaaataaaatgctaggatatgaagaaaatgcaaatctaatgtacgcctactttgtgctacaactctggaaaagctcaatttgatttgggtctgagttaagaatcacctagaactagtgagagcataagccctatttgatttgggtctaagttaagaatcacctagaactagtgagaggataagccctttttattatgtactggttggcccgtgtttagagtacactgttccagtttggttactacagtagaggagggacaaatgcctcagggggatgattattgctatttttagatagctgcaaggcttccatgatgttttataaaaaatgagacagatttttttttatggccagtaagaggagtggaagtggtttgaagacagagagaggacttaaatagattgttagaaactctagagctagacatcagaaatgatgaccatttctccatttaaaaagtgctaaaattttaaatagagagaacaaaaagaatattataaaactattttgcaaagatagtgatctcagtcttcctctttagtctctatggtcagtccatttaagttatctcaagaagcatattatgagaattgaaaaaaagatggaatgcagaaaaatggatctctaatgtacaggtgctctgctttgtctgcaccgctacaatacggagcaactaatagtgagatcaacagaaaaaaatttgaagtgcattggaagggaaaatattagaatttaataataacttagtttcttttttcttccattagggagacatattaaacctttttgcttcctaaagctggaatgggtgagcataaaacagttttaaaataatataactgattttaagatttatttttgatctgtattatgatcaggcattagataaaatgtgagaggaaacattagaaaggaaaaaaagaagatacagaaataaaacctcatttttaaatgaagataactgactaccctgtaattgcactctagacaatagatgaactgtgggtttttgatgatcaaccacatgtttttatcactgcttcctttgaagattccgctaaaatgagagtaaaggaataaaacaggtataaaaccacaagtaacaggtgagaaggacaagggatgtcagtcagacaagagatattaacatagctatagaagaatgaacattgatggaggttataataactgatttatcgaactgcagtaaaacataacccgggagaaattcagtgttaggaagcgctagatacaatagagaataaaacaaaagtctgtgtacagagtactccagactccagagcctgctcaatatgtgaaatgtctctagccagatgtatactctccaggaaaaaacagcagggttgctcttctaaagaagctgagcatccctagaggaaagtttttgcatactgacattttgaagtatcccctcaaaatgacctactttacctaatcatcctaaatcacagcccaccaatcaacaagctcaggttagctacatgagcaaacagacatcttctctgttaccaaataatactgggatatcaaggatcaccagttaaaagtttgcaatgtgaaagagaagagcaaagattaaaacaaaaacaggcaaataaactaaaaaggaacacctcaccttgaggggacagacataatttagggaattaaagagaacgtaagaaaaacaagacttttactttagatttgtaaatatattaataaaataagaacaggatgctatataaaaataaatcagagaataaggaagaggtattgaaaataaaaagaattgccaaaataaaaatttcaatagagaagtaggaaaataaattaaaggaaatcagtctataagtagagcagaaaaaaaagaatgtgaaaggaaaggtaagagatctagggataaaaccaggaagttcatccaaacttaaaaagaaaaattatatcgagtatctttcccaaccacaatagtatgaaactagaaagcaataaagagaatgattttggaaaattcacaaatacatgaaaattaaacaacattctcctgaacaaccaataagtcaaaggagaaattaaaagggaaatttaaaatatcttgagacaaaaatagacctacagtgtaccaaaacttatgagttgcagccaaagcagttctaagaagaaggaaggttatagcaataaacacctacatcaaaaaagaataaagatctcaaataagcaatctaactttatgccttgaggaacttagaaaaagaagaactaagcccaaagttactagaaagaagcaaagactaaagatcagagcagaaatacatgaaatagggaacttaaaaatcaatagaaaagatcattaaaactaagatgtgtttttttttcaaaagataaacaaaatagacaaacctttagactaagaaaaaggagagaagactcaaatacaaaaaataaaaaatgaaacaggagatgttaacaactgttatcacagaaaaacaaagaatcataacagattactataaacaattgtatgccaacaaactgataatctagaaataatagataaattcctagacatacatcacctgctaagactgaatcatgaggaaatggaatatctgaacagaccaataatgaataaggagctgaatcagtaacaaaaagtctcccatcaaagaaaagcccaggacctgatgtcttcactgttgaattctaccgagcacttaaagaagaactaataccaatcattctcaaattcttccaaaaaattgaaaagggaatacttccaaactcattttatatggccagcattaccttcataccaaagacaggcaaatacactacaagaaaagaaaattgcaggccaatatccctgatgaacaaaatagatgtaaaaatcctcaacaaaattctagcaaaccaaagttaacagtacattaaaagaatcattccccagaacttcttaaagtatatatgtatacactatatatatatacactatatatagtactatagtatatatactatagtatttatatactatatatatgtatatatatggtgtaaatatatacatatatagtatatatatactgtatatatatactatatatacactatatagtgtatatatagtgtatatatacactatacctatatatgtatatatacactatatatacatatatagtgtatatatagtgtatatatacactatatatgtatatatagtgtatatatagtgtatatatactatatatgcatatatagtatatatagtgtgtatatacactatatatgcatatatagtatatatatagtgtatatatacactatatatgcatatatagtgtgtatactatatagagtatatatactatatatagtatgtatactatatatagtgtacatatatacactatatatagtgtgtatacatactatatatagtgcatatatagtgtgtctatatatactagtgtatatatacactatatatagtgtatatatacatagtgtgtatatatatacatacactgtgtgtgtgtgtgtgtgtgtgtgtatatatatatataacacgtcaggcaatggctgtaagggttaaatcataaacttaaaaaaaatactcatcttgaccaagtgggatttatcccagggatgaaaggatggttcaacatgtgtaaatatataaatatgctacaccacattaacagaatgaagtccaaaaccaagttgtcatctcagtagatgcagaaaaagcatttgacaaaattcaacattctttcatgataaaaaacctctcaactaattacaatcacaataaaggccatatatgacaaacccacagctaacatcatactcagtggtaaaaagttaaaagctttttctccaaggttagcagcaagacaggtatgtccactctcactacagtattggaagacctatccagagcaattcaacaagagaaagaaataaagggcatccaaattggaaaggaagaagttaaattttccctgcatatggatggcctgatcttttttctttttttttattattatactttaaattttagggtacatgtgcacaatgtgcaggttagttacatatgtatacatgtgccatgctggtgtgctgcacccattaactcgtcatttagcattaggtatatctcctaatgctatccctcccccagcctcccaccccacaacaggccccagagtgtgatgttccccttcctgtgtccatgtgttgtcattgttcaattcccacctatgagtgagaatatgcagcgtttggttttttgttcttgtgatagtttactgagaatgatgatttccaatttcatccatgtccctacaaaggacatgaactcatcattttttatggcctgatcttatatatagaaaaccctaaagaccctacaaaaaagaaaagaaaagaaaagaaaaaagctgttagaactagcaaataaatttagtaaagttgcaggagacaaagtcaacatgcaaaaatcagttgcatttctttatcaacaatgaactatctggaaaagaaatcaagaaagcaatcccattcacaataagtacaaaaaataataaaatacttaggaataaatttaaccaagaggataacagactagtacactaaacctataaaataccaaataaagaaattgaagacacaaataaatggaaagatacccactgttcatggctagaagaattaatattgttaaaatgttcatgccacccaaactgatgtacagattaaatgcaactctatcaaattccaatgtcatttttaatagaaatagaaaagatacagtcctaagacttacatggaaccacaaaatactctgaatgtcaaagcaatcttgagcaaaaagaagaaagctgaaggcatcgtattacctgacttcaaaatatgctctagaactatattaaccaaaacagcttggtactggcataaaacagacacacagagcaatttaacacaatagagagcacaaaaataaattcatgcatttatggttaattgattttccacaaaggtatctagaacacacaatgaagaaaggacagcctatttaacaaatgatgttgggaaaactggatagccacacacagagaaatgaagttagacccttatctcacaccatatgcaaaggtcaactcaaaatggattaaaggtttaaatgtaatgcctgaaattctaaaactactaaaatgaaacattggggaaaaaaatctctgtgaaacaaaggtaatttgaatatgatcccaaaagcataggcaacaagagtacaaatagacaaatgggattacaccaaactaaaaagctttttgatagccaaggaaacaatcaacagagcaaagagacaacctatagaataaaagaacatatttgcaaaccaaccatctaataagaggctaatataaaaactatacaaggaacccaaacaactcaatagcaagaaaacaacccaatttaaaaattcacaaaggacttgaataggcatttctcaaaagaagacatacagctagataatagttatatttttaaaatgctcaagattactaatcatcagaaaaatgtaaattaaaaccacaatgagatatcacctcacacttttaaaaatgtctgttatcaaaaagaccgaagataactgttggtgaggatttggagaaaagggaatccttccacactattggtgggaatgtaaatttgcaaagctagtatggaggttcctgaaaaaattaaaaatagaaataccaaatggttgatcgaccccactactgggtatatatccaaagaacttgaaatcagtatgtcaaagaagtatgtgtacttgtataataattacagcattattcacaaaagccaatatgtgtaatcaacctaagtgtctataaactgatgaatagataaagaaaatgtggtataggcaatggaatactattcagcctttaaaaaagaaggaaaccctgtcatttacataagcacggatgaacctgaagaacattactataaatgaaataagctaggcacagaaaagaaaaataccacatgatgtcacttacatgtgtgatctaaaaaagttgaactctaatcccagcactttgggagactgaagcgggcagatcacgaggtcaggagatcgagaccatcctggctaacatggtgaagccccatctctactaaaaatacaaaaaattagccaggtgtggtggcgggcgcctgtagtcccagctacttgggaggctgaggcaggagaatggcgtgaacccgggaggcagagcttgcagtgagccgagatcgcgccactgcactccagcctgagcgacagagcgagactccatctcaaaaaaaaaaaaaaaaattgaactcacagaagcagagggtagaatggtggttactggggactgggagttgggggtagttgttggtcaaagaatacaaaattttacttagagaagaataagttcaagagaccctatcgtacaacaagtgactgtagttaatagcaatgttctgtattcttgaaaactgctaagagtagattttaaatgttcttaccacagaaaatgataactgtgaggcaatgcatatgttaattagcccaatatagccattccataatgtacacctatttcaaaacatcattttgtacatgataaatacatgcaatttcatttgtcaattaaaaatgaataaatagaaataaaaattataaaaagtgaagtactaaagtgacaactgtgcagcaagcaaatttgcaaaggaaccagtccagtttgcagatggctactacagggatttatacagtcatttataatgctatcaccactggttattgatagaactaaaaagtttgctataattgtactagaggattcaggaagggttacatatgtgaaataaatcatttatcatgaaaagacaattggtagtaagcaaaactggtagcagtataaatatattgtataaaagtatagaaataactattagaagtattactatcacctaagagaattaaaaataaatacctacaaggggctggacaatgggtttgggtgcattggggtaagggtttcttgattttcataagttttcaacttcaattttttaaactatgtccattactactttaagttattcaacattaaaaataataaaagcaaatttaaatgaaaaaacaaatctcaacatttaaaaagaagaaaattattcttagaaccatttataaaatttgtataacttcttgtataaattttgcaaaaaatagtaatgcttggactttctttttttattttcaaatgctctagaataaaattttatcttttttacattggagaaaacattcacattctcttcaaatcttggaaaagcttagtttcttgtccttaatggcttttaagtctatgggtcattcctgcaattgtagccacaaatcaaatcaccccttggtatttctttgttgggtaagtaacattcaatatgggttaagttttactcataaactggtggtcttcctaccttgctctgcagtaggtataagtggcctagcagtaatcatagtctcgattgaaacacacacacacacacacgcacacacacacacacatagacgcacacacggcaattatttctggaatacctgtggtttgcaaaactaaactacatggtcccagtactcaggacctgatggtctaagaaaagtaaggcatatatccatatatatatacacacatatacagacagagcactgatataggacaaagtgctgagtgtcacaggagagataaatccaaaatacttcctctctattttgttgtttaccttactgagtacttgactgtttcctaaaaaatctactgcccttgcaagtggaagccactcctccattccctcctgctgcttccaggccactgtttactcctttacttcatgcaaaaagttttgtcctttgatgttcacttcatctggctttatcactctatttttcttcatcttgctcaacttagcaacattattgtattctctccgtgttcatttcatatgtaggatttctacaaccagttcactttatttgcaactgccccaagttctctctttgtttttcaattggatgactcatctgacatcataaactggaattgagcctattaaatgaggtctggattgtcccatttaccaggcattgctactgtttccagcactacgtgaaggtttcagaaatgaaccaatctaactgcctgtatatttgttctagtgttttgtttttgttttttgtattttttttttttttcagaaaaacagtgacagtaagtcagctaattgtgttagtgtttttggaactgttacttgacatcagaagagttttgtaatgaaatttgtggacacatgaggccatatgttccatagggctcgcctctgtgtcatccttggtcaatacccaaattgtagttttctctatggttatttatcctcccctcacttcttatccttatcctcttctgtggttttttcttgacgtatcctcctactcctcataaactgtccctcacttccctcaggaactcctgttcatgggaagataaaacattctgccccagcagcttcttcattgaatgacccgtccacctcctgttttaactgatatgtgattctcagttgagacttccttccaactgccttcctgcttggcagaagctgttaatcagattcccattttccagaagtgtagtttacatcgtcttaatccccagtactgctttcagaccattactctctcactctttgatattaaagatgtcttctttgaaaaaggtgtcaactcctcacttggattctcatacatcaggatttcctgtttttcttgttcgtccttggtattttctttgcactatccttgtcttctttccagcactaaacgttagagcatttcagggcagctcagtcagatctgcaggccagtcagcagtctgatctcttttttattttctgaatctgtactcacttctcaagcgacctcattcaatcccaagacattgaatcaatggccatctagaggcgaacaacttccaaatatgtatctctatcccaaacctttcccctaagctgcagactgatatatgtaactgtgtacatctctattgggattatattcctattgggatgtctgataaaaatgtaattctcatatccaaacacaactcctcatcttccccctaaacctgctcttcttcaagtcttcccagcacagccaataatgtcactattcttccagatgctcaggccaaaaacctggaatccattcttaattcttttatttttcttacctgcccccaactctgctctcagacaacccaaacctaactcatcagcaagtcctaactcctctacgtgcacaatataacttgaatctgtctacttttctccatatctaacattcaacacaccacacctcttcactagcctcattaggactaacatcctaattttagtcctttactttcagtgcctacacatctattctctgcccaacagtagggaagatcaattaaaatagtaaattataaaaattctgctccaaatagtttaatggcttcccactacatttagatcaaattccattattcttacgatggtgctcaaaaccttacaggatcttgtccttagatctgtgatggtacctcttaccatcttttttgaattttcattcactccactcactcatcccatagtggcctccttgatgattctatttatttatttatttatttatttatttatttatttatttatttttgagatggaaactcactctgtcacccaggctggagtagagtggtgcaatctcggctcactgcaacctccatttcctgggttcaagcgattcttctgcctcagcttcctgagcagctgggactacaggcgtgtaccaccatgcttggctaattttttgtatttttagtagagactgggtttcaccgtgttagccaggatgatctcgatctcctgacctcatgatctgcccgccttggcctcccaaagtgctgggattacaggcgtgaggcaccgtgcccagcctccttgatgattcttaatgaatcactttcattccaagcccaggtactttgtcattaccattctttctctatggaatgtttattgttgagatcttttcacagcttgctttcttattttgttcaggtctctacttaccttctcaggcagaccttctatcactagcattcatcatctttttctgcactgccctgctttatgtgcttccatgataattctcacctcctgacattacattgctttatgcatttttttgcttctatgtttattacatgtccccccaactgggatgtgaactcctttagggcaggagctgtgttttaccatttattcctgcaccccaagcacctagcacagaacctgtcacattgtagacgcagaaaatattaaataaatggatgatttcctatgttttccttgcttctctatccagcataggtcccacactgtatcactgcagtcactcaccagcactcttgacctccctagtcacttcagtccaagtcctctatttctctccgaaaaaaaaaaaaaatccattgctattgatggattggtgacatttatgagtgtatttttgaattctgctgttccttcaacctatgcctgcagttactctctgtccctaattagttctgtcttctttattctacaaaatctagtttaaattagccaggcatgtctacagctatctgatctttgacaaacctgacaaaaacaagcaatggggaaaggattccctatttaataaatggtgctgggaaaactggctagccatatggagaaagctgaaactggatcccttccttacaccttagacaaaaattaattcaagatggattaaagacttaaatgttagacctaaaaccataaaaaccccagaagaaaacctaggcaataccattcaggacataggcatgggcaaggacttcatgtctaaaacaccaaaagcaatggcaacaaaagccaaaattgaaaaatgggatctaattaaactaaagagcttctgcacagcaaaagaaaccaccatcagagtgaacaggcaatctacagaatgggagaaaatttttgcaacctactcatctgacaaagggctaatatccaggatctacaatgaactcaaacaaatttacaagaaaaaaacaaacaactccatcaaaaagtgggtgaaggatataaacagacacttctcaaaagaagacatttatgcagccaaaagacacatgaaaaaatgctcatcatcactggccatcagagaaatgcaaaccaaaaccacaatgagataccatctcacaccagttagaatggcgatcgttaaaaagtcaggaaacaacaggtgctggagaggatgtggagaaataggaacacttttacactgttggtgggactataaactagttcaaccattgcggaagtcagtgtggcgattcctcagggatctagaactagaaataccatttgacccagccatcccattactgggtatatacgcaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgcagggacatggatgaagctggaaaccatcattctcagcaaactatggcaaggacaaaaaaccaaacaccgcatgttctcactcataggtgggaattgaacaatgagaacacatgggcacaggaaggggaacatcacacaccagggcctgttgtggggtgaggggagaggggagggataacattaggagatatacctaatgctaaatgacgagttaatgggtgcagcacaccaacatggcacatgtatacatatgtaacaaacctgcacgttgtgcacatgtaccctaaaacttaaagtataataataatataaataaataaataaataaataaattagccaggcgcggtggctcatgcctgtaatcccagcactttgggaggctgagaattgagtacagattcagaaaaaacacctgaggtcaggagttcgagaccagcctgaccaaatggagaaactcccttctctactaaaaatacaaaactatcctggggaggggggcagcggtggcacatgcctgtaatcccagctactcaggaggctgaggcaagagaattgcttgaacccgggaggcagagattgcagtgagccgagatcatgccattgcactccagcctgggcaacaagagcaaagttccatctcaaaaaatatatatatacatatatattctagtttaaatctttgctatttatttaaccttcctcatggggaatgtagaagccattgtatgagatttcccttaacctactgtgctcctttctctccaccaaaatatagtatctaatctcatccattctttccttctcagctgtgatctggacctgagaaattccacacttatgctctagataacccccacccccccaccgcctttacaggaaagtggtgcaagtgattatttttcttccatctgcattttctctcctttccattgacttacctgacagttccaaattcttccttctcttgaactcccttgatttcattattcatgcccctctgaatgtttctaatttgtgctttctcctgtatattttaattctctcttattttaattaaccttcctcactaaactagatttcctgagggcagggtctctgatttaatcatatatgtgtatatatgtgtgtgtgtgtgtgtgtgtgtgtgtgtgtacacatactcgtaaatatatataaccttaatcaatttgaattgtgtaattcagtcctgttaaatacattcacattgctgtgcagtctcctgaacccttttcatcttgcaaaactggacctctgtattcattaaacaacaactccccattcctttctgccctagccccagcacccaccattctactttctgtctctatgaatttgctactctagatatgtcatagaagtaaaatcacataacagttatccttttgtgactggcttatttcatttagcatcctcaagattcatgtctgttgtagtatatatcagaatttccttcctttgtgaggttgaagaattgtgaatggaatgaattcattgtgtgtatataccacattttgtttattgttctctcgatggacacttgggttgcttccaccatttggctattgggaataatgaaggtgtgaacatgggtatgcaaatatctctttgagaccctgcttataatttggggatatatactcagaagtggaactgctgaatcatatagtgattctatttgtaagtttttgaggaaccctcacaacattttccatagtggttgcaccattttacattcccaatagtgcacaagggtttcaatttctccacatccttgccaatacttgatattttctggggttttttggtagtacccatcataatgtgaggtggggtctcatggctttgatttgcatttctgattagtgatgcttaccatcttttcatgtgattgttggccatttgtaaatcttttttggagatatgtctactcaagtcctttgcccatttttaaattgagttgtttgggtttttgttgttggttttattcatctttgagtcccacatagcatatattccattgttttgccccacttctggaaatgggctcagaaaagctgagcacctgcaagggggttgacacagaggcactggaccatgtaagtatatactctgaggttctagttgagcttcacctttagagacaattgacaggagtatcatcggaggaagactcttgagtgggacatgcatttctctataaaagttttcattgcctcatcacaaaacccacatgaaatagatttttagaaggaaaggcgttcctgttctggattcaaactccttgggaaatttggagaagtcaatttccactttttggttaggaaattgccctaggctgaactttggagacatgctatttatgcagcaaaggtcaagactcaggggaaacaaacaataaatcacattgataatcttcaatggtgggtattttttcattcagtaaacatccatcatttgcctaagagccagatacttggctagggggtaggaatattatgacaattcggtcaaagttaagtcatctcagtctgtatctatcaaggagaattactggaaaactaggtgtagaaatgggtaaatattaccattaatctatggctcattttcctattttcttgacactcaaattttgctttgatttccttctttaatgatttaggtaaaaaattgtagtggctgattaaaatgtgtcatgttgaaaatggtggaagaaattaaaaggtaattttcccttactacttaaaaaatctgtgattaacgtgattgctgcttctccccatctatagaacataaagtgcctatggagctaaaaaaaagtattcattgttcagaatcactgtttcagagacttagtcatagccagtttataagatggctaagtgaagtaacatatataaaagcttctagaaaagtcagggcaatattttctttcctttcttttttcttttctttctttcctataatttttggtctacccatgaaaaaagagtttactaagcaaattaataagcaagtttgcaaacaagcaaagcacccttttatttaatagcaaagacatttagcagcagggctctattcacacaatgaatttgctaattataagtgagtcccatgtagtatttaaataatttacaaggtttttagaaaccttagagttctgtcccccttccacttgtaacaatgtgattgcaatccccagggagaaagaatattgctttcaaaatatcctattagtcagactgttcaatttacgtaaaccaacatcctctcatctgtcgcacttcccgtccatgactgaaaacactgaggccaaaataagcagacaaagcaagagagcatagcatataaggcctttcaaggtcttgctgctgcctgttttacacagcctcagtttctgcaactctttgccatgcacgctgtggcccagctacagtaaacttcttgtcaactcaaaaaacagtgcccttggccaggtgtagtggcttgcacctgtaatcccagtgattttggaagccaaggtgggaggatcacctgaagccaggagtacaagaccagcctgggcaacatagtgagacatcatctctaaattaaaaaacaaaaaaatagctgggcatggtggcacatgcctgtagtcccagctactcaggagcctgaggcgggagaatcacttgagcccaggagttcaagactgtagtgggctatgtttacacaaggcccaccagcccaggtgacagagcaagacccatgtctctaaaataaataaataaagtgtccttggcctgtgtactggcctttgccgcatgctcatcttttgtgacccagagcataaacttcattgccttctctgagccaccttttccaatgcctgcaggtactttgtccctcctttgactgatttcccatagtacttggcccagatctttgagaagtctgatcacgttcaatggcaatcgtgtgcttaaaaggctttctcccacacccgagtgtgagctcctggaagacagggactcatgttttaccctttccatttatctctaagtacctagcatagttcttggcccagtacgcattcagtaaatattgggcaaaagttattaggatcactatagtaaatggcagtgacgtctaaaggagaaaaaataagaatgatggggactctgaagttaagaagaaaggatatatgaagagatgaggagataggggtcagcaagagaggatggaaatagagaaacacacaaagaaaacaagtaggaagtgaaggaataaagaagtgaagcctgggttctgggaagcaaagtaacatcaagaatgcactcatgaggtatgtgaaattagggcatttctgaagctcatctatacccacttttccctagagccaaactgggatggaagaaaaggccagagtgaggaatgaggcaacaaaccatctatagactatgagctaggccactgcatttggcctggggctggggttggcctccttccctggcctctcctgttcttcagcttctcagtttgtatccaggcctaagcattgtctcctcttctctcttctgcatcaggggaggcccagtgaggctctctgtatacacaagttcatatatatgagagcaaattggcctgtgtgtgtgcttgcttcccactgggtgtttgagtttctttcactcttaaaaataagcccaaagggcagtgacatagcaactccgcatctatctctgcctttgctatgtcagagagtcttttacatagctctgtggaaagccttggcccgctcctgagcttgctgaacagttacactgcatgaagggtgggaagctgttgtaatgatgcatgtcaacatgccatggtatgtattgtctttatgacaaaatgacttttcagactcaccaagctctcttcctcacaggagatgtgccacttgatggtcacggccttctggagttatttcttgggtaaccaaaaagtgtccggggcctatagaaagcagcacagtgtagccctagataaaaatctcttacccagattgcaagttaggctctgccacttagtctgaggctgagttttctcatctgtcaaatgggagtaatctcatccacctacctcataggggttgctctgaggatcgaatcacatgatgtataagattccacatgtgaccaacattccacagtttattggcgatttctagctccattctcttatctgatcctctcaacaatcctgaaaattattttgatcctcattttacagatgaagaaactgaggcatgaagaggaaaagtgacttagccaaagcgacatagctcgtgagccaggatgatgcacgttttctcttttcatactcatcttcagttattccttgacacaaacctggttactagtgctattggctacatggcccctgtgccttaacttccctcatggctcctcctccctgcagcctctgaaggttctctgtgtaatgaattaattagctttgcttttttctccctttccccccctctttttcctggcctctagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccccttcgcgtatttcaggattctcctttttacccctctaccaagctgtgaccctcaattcatatttatgaatctctacgcaaaaaataactacagaaaaattacttgtccctccaatattgcccagtataaccccatcaaagccaaacactgccatttgtccagttgctcatcttagtctgccaatctcccctagctgagggcactgcatgtattttattgcactctgcccgctgcaaaaagaacaagagattctactctccatagtggaagccttggctgtttgagaggcccagaacaaggagaattgttgactcccatctagatcagatgactctaacttactaggcagccaggttaggctaggccatgtgatcctgcgtgccacctcccctgccttcagcaaggcctactaggcataagtactgatagcaaaggtgggagccagttctacacccccaacccatttattggtttggaaattagtggggacaattggtactaaccaccgtctaccatgtatggccaaaataaatagaactagctctgccagcctggcaccaagatggctggtgccctgccatgtccagcccctcgggaaaatagtcccctccttggtacatctctcctccagaaaatcttcttcccccactgcctttggcacccttgtagccaactgagcactacttaatttggactcattaccacctgtaaacttttcaggaaaaaatgatcaagcattttttatttatatcgaaaagttgcaaatagaaacaaagtgatctagatttaaaaaaaacatttttttaaaatatgggagagatacaaaagtcacctccctgccaaggcaactagcctatactggattgggtaagaggtttggagtggatggtagttgaggattgaagtctggctcaaaagagaaggctactggcagatgaaagtcaaattcttccttccatacactccacattccacaccctggcccaggcacttttctcccaccatatcgggaacctccggtcctctgttgatgccgattctatgaggggtgaattggaaattcatacaaataaatatctctagtcaatattgagtcaactagatcattaactttattgccaattttataatatattatttagaggccatttgttcttaatcttaatgtgagtaaaagacacaggcataaatacgcaatttttataaggtagataaactgaatcccagaagtttgaatgatttgcctaggctccttacaagtgtctttaataaagagctatcgtgcgcccctttccaaaggccaaaataaaggactgagaagccaggtccaccgtgacctcagaatcagcacaatctcagcgggccttctgggtcactagtggaacttggttgggcaccaaaaaggtttttagaaagtcacaatgtgtcacccaagaagatcacttttaatagtctcagcccaagagaatgagactgtttatgatggcagccccagccactttggctctgaatacctgcactagtccagagtatcctagaagcccagggtaaagccacagagggcaccacaagcagattctccctgcccaccggctgaacaaagctcctaaggggtgtatcattagctgctggttgccttttcatccatcctttccccgtcccctgcttccttgccattgctgggataatgcatgcccgtcccattattcctaagactgtgtctgtaggtaaattcatgactagaagagtgtagtcttgtggatatgtggggatatggggggtgggagggcggggctgttaatggttgtcttaaggaacttagaatggaagcctgatctttgcctctctgtagaaattgtgtttccaaatgctttggtgcaatgtttagctgctgtttattaaaccctttctgaattgtacttggtctgcagaactttctttggtcactctttgcctaacacagacagtactatgtttttggctttcacccccaatctcatgccaccattactttctgcttcttaacaaccattggaaaaagatggaagaaaggtacccccagagcaagaaatgtattacaatgatccaaagtaaaactcgtgtgaaaacatagctttgattgactcgagggtctcattgcccaatatgaaatattatgaaaaagctgtattgcttcttctgctaaattcacccactcccaggaaatagagcaatgtattttcattgtaattctaaaggatttctcttctccatggcttactattttccctttggcaacagttcccattccaggaacacgaccccatcttttggttccctgttacacaacttggaagagttggcaacttcaaaggaatttgatcgtacaccaagtaaggacaactaggagactaaacctgaaaatacaaggtttaaactctcaggtctaacagtgatctccccagcctccccacccctatcccacactcagatctttgccctcagctccatgtggcagggtctcccttgatgtgacacaggatcattagtgccccaactccagttctagcatgggaaaagttggatcctaaattgaggagattaagggggtgctggtgccgggaagggggcccacaggcaaactgagagcaaagagcagaaacaaaacagacattcccccccttttttttctccaaagtttcagctcagggaagaacagcaattcttagaagggaagtccctacacatgacaaacagactgagcccttgggatctacattcacaacctctcccttctctgctgtcactggaaaaagtggtttcccttctgtctaaggcccagcctctccttttgttcttcatctctgctcctctcttctcaaagaattctaattttgttatctgctctcagtgaagctcttcttgctgagtcaccactgcccttgttactaaaacctaagggcagttttcagttatcttatttgacctgtcagcatttgacactgttgaaaactattttattcttgaaaatgcctctttctggtttccatagcaccatagtctcctgatatccctgctttttttctctgctacctttccgtttctcatgtttttccttttcaacttctctcatcccttaaaggctggggttccctccagtgtcttccctgttctcttttcactctccacactctcactgagtgctctcatctgtcctaatggcttcaattagcacatactaccattaacttttgttgggtaacaaattatcccaaaataaaacaaccacatttattgtaccgataggacagtgcaccgcagggatggcctgtctctgatccatgatgcctagggtcatagacgggaagactcaaacaagtagaaggtgacttaattgactagaacatctggggatggaggatatgcttcccagctccgtgtgaaaagggatggattctgtagtaagatgtaggagtattagttgcctagctccagtcttattcagtaggacaaaatttgagtcttcaactgagaagataaaggaggttctgagttccacattgggggataggggctttcactcacatgtctggcagcttggctctgagtgttgaaggacaggttcatctggaactgttgactggagtttctatacatggcctctccttgtggcttcttatagcatggcttctgggttctcataagaaacatctccagagggatgaacaagcaaccaaagagaaccaaatggaagctgcatggcttttattggcccagcctggaaagtcatgcagtgtgcctaaggccagtgcagagtcaagaggaagggtggatagggccaaagactttgcagatgtgtataaaatctgctattcaagaggctgaggaggaaggatccgttgagcccaggcctttgaggctgcagtgagctatgatcgtgccactgtacttcagcctgggacagatcatgactccatctataaaaataaataaataaatagatagatagataataatttaaaactccaccacatctcctttatgctgatgactgccaaatgaatacctctagcttagttctttcacatcaaattttttgacaagttcaaaacagtactcttgattcctccaccctcacagttcttcccttggtcattattttgtcaataaatcagaacgtcactcacccagatgctcaggccaaaaccctatgaggtattcttagcctctctctcccatccttacatctagtacatctgaaaatcttgaaagctcagcctccaacttaaatcccatattagccctacttctactacctgtaccccagtccaaggctccatcatgatctctcaccggaacactacagagctatccttttaaatagtaaactagatcattcacttgcctgttgaataccctccaatggcatgctgcacatagactaaaattcaaactctagccttcaccttcaaagttttgtgtgacatggtcctgttcactcctcagcctcctgttttcacaatgcctgcctctcactcacatttcatcaaccacatcaactgcacatcaagtcccaatataacttatggactttatgcagggtgtttcctcagtctagcaagttcgttttctccttgccttcactggctgatgtctgctcacccccaagctctcacctaaaaagtcacatctctcaggcctgtgtccttccagactggatgctttgccatgttgtgtgcttctattacactctgtattgctctcactaccccaacactcaccatgttttattgcagtctcccactagactaagaaccgtgagggagagctgtccttgtacacaagtgtaggatcaaaaccagagtctaaactcagcgaatacttattgaataaaataacttctgagttgggcttcaaaagatgattcagaatttatcaagcaagaaagataatgggtattccagacaggatgcacaaaggcccagaagtgagataaatcttcatgaagtatacagcaaaacatatttgtcctaactatccagacattctacccattagggtggatgatgaatataatggctctggacttaaaaggtggtacaagggacacaacatgtcatatacctgagaacctggctgcatgccatcattttgatgacttatctcaaaaggttggctttgacaagttcagaaaggtgctagcaacacatgtgagctgctttggggaaagccacttgctggcccttacgattggcgtctccattccaagccaacatcctgtagactcaaagtcttagagtttcccttccttgaagcctctcttcacccttgccaaccagcaaacacatcctcattcagatcactgaagggtcaaataaaatgcacaaaggtgcatgaaggataataacaacactgctaggtcttttgcaggctgctaggttttattgtagcctcagaataacagaatagcactaaaagctgcacaaggctggaggcttgactctgcattccagcaaatgaaattttatacctgcatatgtcatgttgggtaacagctctagggtattcatacacttcgagctgggcctcctttctgaaatacagatctagcctagaatcatactgatcatctccctgcctcttgataggaagaaatctaggaaagtttaatgaattcttactggcaaagtggagagccagtgaactcccagtagaactagtactagtgaaatccaaggtcttcttaagtcaccacattccctccatgctgtagtcagaagaagctgctactgaccctgaagctgtctgctttcttcaaacaatatccatgctgagctggtgtgctatgatgagccaaattttccaggcttcaatggcaccagcagacctcctccatgtcaaggtaaatgggatatgttgcccaaggttggtcttctggtctatggttacctcagctggtaaatcagttctaggcactttggttttagggcatggtcacactgcaatccctttcaagaagccatgatgatagatgcagcagagcctggatcttgggcaggtggccctttcctcttgtaagtactaatatgtggccatgtaagaggcttggatcaggaatggtctctgtcaaaatccatgagaaaaataagataccaacatgatcatgggaaaaagcttgtggtggttggaactagtgtgaatggtaaaaagatacaggcacagggaggcaggaatactgagttctaatctgggatataccactgtcccagctgtgtgaacttgggcaagtcatttaacctctatgtaacacagcataataataaaactttcccagggatgactacaaagattaaatgagctattgcacatgaaagatggttacaatctttaattgccacttatattgtattagtctgttttcacactgctgataaagacatacctgagtctggataattcataaagaaaagaaggcttaatggactcacagttccatatggctggggaggcctcacagtcatggtggaaggcaaaaggcacatcttacatggcaggcaaggaagaatgagagccaagcgaaaggcgaaaccccttataaaaccatcagatctcatgagaagcattcactaccatgagaacagtatgattcaattatctcccactgggtccctcccacaacacatgggaattatgggagctacaattcaagatgagattggggtggagacacaaccaaaccatattacgtatgtaggagatacatctaatcccaacacggttcctgaattgaaataggccctccacatctctaggtctcaaatagtcacctgtgtaatgaggatcttgagctatgtgacctttaagggcccttctggacttgatattccaggattctagccaaatttatcagaaatgaagtcaattatgtctgtatacaaggtattctgaaatggtttttattgtttacatgaaggaaatgttgtgatgtgcattttggatgcaaatagcagcaaagtacatattgaggggagggaaatccaatgctcccgaagttccaaagtcccagtacctgacaggataaatactgactgccgtgctcatatttatcctttgagctgcaatcagatcagaggaaggtgtaaggtagaataacaattctcaacacaattatatgctttccgaatatgggttgataatttatgattttctttattttgaaaatttaaaaaatcatcttgattgttctctggaaataaaatatcttcctgggaaaatttctgctcttgagaaaggaggcatactggtggacagagcagatattatgtattaaactcctgacatatatttggcttttgagtttccttctttccacctttctctttatttctccacatttggataccagcacagtgcttagtacatagtagaaggctcaggaaatgatcgttgagtgaagaaatgaatatgatggagacgagtttctcaaaatcctaacccagaacaacttgtaagttggaagagttacacaggaacttagggccaaattaagtaaatgaagggatagtgacaacaacaatactaacactgagaactgtcatccactgagtgcttcctgggtgccagttgctgtgttaagcactgacaacaactctttgaattggatatggttgtttgccagatgccagcctgcttctgttgtgcttcatgtaataaatggaaggggactcattcacttgcagatatttattgaaaacctccttggcatgggtgtcagtcctgtgctaagtgatgggggttctgcagcgaaggcaagcatggagtgtgctctaaggagggtataatctagtgtcagagagacaggaaaagaatcatgaaaaggttgaatgtcggagtcggggggagcatggatggggcccttgactagcctgagacactcagggaagagctttctggaaaaactagcatctaacctgtgacttggactgaataggtggcttgtcctaatcaagagtggggtgaggacaaggaggaaagtcagagatagagagagagaacagcagaagtaatctagccaaaggaatattgtgtacacagagtaaggttacagatactgagtagttaattatggttagaggggagacagaaaagggaaggaggctattagatgaagctgggaaggaaggcagagacaggtcatgtgcaaaggcttctgtaagggttggggaatgcctttagaccttaccttcaaagcaacggacagacactaaaagatgttaagcaagagtgtggaggagtaatgataatggtggcatggtgaggtcatgactgggcccaagttctgtgttagacaaggagatgctctggcttcaatgacagaatggaataagaagggaagcatgggcacacaagtccagtgtaatcatctgcttatgacatgatgaaccctgaattatacagtggaactgggagtgaagcagagggcatgacctgagagagatttagaagctgaaatcattgacacataaagactaattagatactggtgttgaagaagaggaggcatcaaagatgacagcaaagaaggcatctgacttgagtgactggggaaggtgggtaatgtttctggacatgggtaagaaacactggaggagaagcaaatttgagtggaagatgacgaactcagcaccagacatatgaagatggaggtgtctatgggtcatgattggtggaggtgtgctggaggcaattgtatgtcatgatctgtaggtcagtgtctggatctcagggtctggaggcctgaactcaagaaaacaatatgggatcaagactttgtcagtgtagtaaaggttgtaattgaaaccttaggacctccttatgtctcctgcccctgcccaacacctccagtcatgggaaggagtgcagaatgagaagagaatgtggcccagatattctgaagaggagcagatgcacttaagaggtgggcctgggacaagcagccagcaagggagactgacaatgagcagccagacaagcacaaggaagaccaggaggaggtggtgttatgaacggaggctgagggaggaaagataggatttctggaaggatagaggagtgggcatgttcagtgatatcagctgctgctgctgattttagaaaggacaaggactgaacatatcttctttagatttatggacaagagcctttggtgaagttcatgagagtgctctctgtggggtaatagaggcaggagtcaaatgggttgataagtgagggagaagagaagaaaggtagtgaacagaaaggactcctttaggacattctgcagaaaggaaaacaataaatacacagttgtagctggagggaatgtggggttaagaaaggttgtgataagttagtttatttttatgtgggagaaacattagaaagtttataggctgaggagaagaaactaatagaaaaagagaagaggaggaggagaagggagtgagagaataagaaaggattgagagaaagaaagacagaagaagggagggagggagggagggaagcagagaccagtgaagtggaggtgagatagggtactgggctcagagagcaagacacaagaatgactatcaataagaaatttgttgagagtttggtgcccagaatccttcttgtggtaggcagaataatggtacccccaaatatgtttatatcacaatcatcagaatctgtgaatatattattttacatggcagaggaattaaggttgctaatcagttgaccttaaaatagggaggttacttgggattattcatgtgagcccgtgtaatcacacatgagccagtgtaatcacacatgagccagtgtaatcatacgtgagccaggataatcacaaggatccttatgagtgaaagaggaaggcaaaaattaaaaccatagacatcacagcctgagaaggacttagctcaacactgttggcttttaagatgggggaaaggggccaggagccaaaggatgcaggtagacattgaaaactgcaaagggcaaggaaatggattatcccatagggcctgcaaaaggatcacagcccggtggcactcattttggacttctgacttccagaactgtaagataataaatttgtggtttttttaagtaactacatttgtagtaatttgttatagtattcataggaaaccaatacactttccctcatctttattcctttccaagattttaaccactggaaaataactaaggctcatcaatcaaatgtaagtttcagtgctggtttattaatttgggtaaacatttaaaagtcctatagtacaaggtttctcttcaaattctgtttgaaactggcttggagtggcaggatgttcatcctacaaaagtctactgctcatagagccctatgcaaggttctaggaacatagtggagaacaaaacagaccagcactggcacagagggcagttttcaataacatgcaacaaaaacggggcacttgaaccacaggtgtccaatccttagatttgcatctttagaaaaacctcgttctagctcagtgatttttagtgatttttgccagcaatgtcgttgtcctcatgggtgaactaagagcaccctgtagacagaaccaggaagaactgaattgcctgggaagaccatatgtggacagggagaaaccacacaagttgagagcttgataagcattagggcaaaaggacaaggcccagagcatttagaatattggtcaaagccacagaggcagctctggactgcagaacaatgacgcctaacaggcaatgcctcactaggagaaagtcaggggattgagggtctgaatacttgaggctgtgtttgatccctgagtgtgctctgtccctgtccttgctcccaggcccatcatgctataactgtcacagtgctgataacagtgtgttagctagctatctgccacaggaccatgagctccttctgggtagggggagggggcaactgctgatttctgtacatatcaggttattgcaagttccaggcacagaattgtcaatgtctttttgactctggaaggagaggggaagagattcacagagactctaagccacagcgtaagttacagatttacctgagagtagggaagggagggagtgatgaaaggatcatcctttttgacctctttctctgttactaatgaagaggccagccttccaagcctcttcattattgaccttttcattctcccacccacctccttgagggattaacaactaaataaaactcactcgaaagatgtcttcagtgagcagtcagggagggaaatcccagcagctatggggttgtaagagcaggggcagctgcatttaaggtcgtgtcagtgggtttgggggacagcccctgaactctggattctgggtaggatgcccacttcttatggaatcacttagggcctaagattcccactttacaacagacccagggaccaagaagacataggcctgaggagtagtgtctcagcaaagcctctgtgaaattttggtacacgaaggaccctgagtttgccaacagtcacattctatcaattgggaaagaaaagcacacatttccacatcagagaaagagattcctagggaagatagaactggtacgttagttgccttggttcccaggaacactttaaactgacgccagtgactgcttcattttatgacatccactcaatgtattatagttattcacatatgaacaacatttttgtatcaactttcctctgatgtaaacacacaaacacaatttttgaggagaatgaatttttaaattgtcttttatatggtgtatgaatccacaaatcagaccaaggctattgcattaatgattcttcgtcatcaagcagagaacaaagacagcaagaaaaaagcctttcaatgcccccatccactcactgtgatttccctgtcccttgcctctgtggatctaatgcttctaatgcttcacggctagcagaagtttcacttttatcctgggggttcaagctgggaagagtgcactcagaacaagggtcaaaggatgtaatttgaaaccaagaaaaaagagtgatgcaaccttgtccaggagctgtgtgaaaacatcttcatcttatagtgatgccccagtcacttgtatgtcaggagtttggtgctccttctcaggctgcccactgaagctatctttcaagtggacttcatttagctgtcaatcatctgaggggatgggagaaatggaaatggaaaaggagacttgggatactggaaccagtgaagagaaagatcaaggaggatgacactttcttctctctctcctttcaaaattatctagatatatccttttcctcctatttgaaaagctggaagctcaagataaaacttgagctgaagttctcaaactgtggttctttgcctttgtgcccctttgctcccactctttgagattaacagagggaaatagtatttcatgtatagaaaacaacatttgcaatggttcagaggctcaaagtccaagtagctgttgaggaactgctaggaatcaagtgtagctcaaaaggatagtactgggagagggcagagaacatagtgcagaagcacatgatagagatgtgggtatagagatgtgggtgcagagctaagtacaaggcagtcatgcagagctgtgtaggccagggtcaggagtttgaactttatctgaagatcaatgaggacccactgagaaacattacgtaggagaatgttatgaccagatgagatttaaaatgatctctttgctgctggtagaacagaatgacaaggagtaagactgcttgcagggaggccatgtaggaggctaggaaatgtgttcaggcagtagctagtgttctagacacctgaaaatgcaaagtccagcctttctaacaccctttttaaagaacacttaaaaaatacaatgtacaaaatttggtaactaaatatgggaatatagaagaggaaaggatatagcttgataatcaggtttctagcttggatgtctgaatggatggctgtgttatttgttaattacggtttggtgttgagagttcaggatctcttgagtttagtttggggacatccaattagagatgttcaggaggaagttggatattatggaaccgaggctaggagaaagatctgaatcagagataagtatttagaagtaatcaggatatcaattataattaaacttagcaacaaagaaatccgtagtaatcccagatagatcacttttaagttgcaggtaaattttagatgggctggagggaaaaaacaggggaaacggtctgatgaattctattttatttggaaataggagagtgaaaatatatgctgagagtgaaagaaaagtggtttgaagagagtagagaaggtttaaggtagtcaaaggaaagaccaggcattcaaagagccagttgaacttgcagactatgaatattcactgaagtcaatctgcttattggtaagattttctctagcagccagtgttcatcagactaagaaaatgaggtcaataggagaatggcttgttagataaatgaggacaatggggaaagtaagttctcagccctgggattgatacagagtaagataatgagtggatgaacgaatgaactaataatgaatgtaagggactctgtgagtccacctagaaaaaagtgagattcagtcaaagcaattcttgtttcacaaccatgtgtaggctcaataccatggagagagggtctttctcaatttccacagacatcctaaaagaaggaggtgaagcccccaggggttcatcccacattagcattggaatttatcactgccctgaaccctattccaggaccttgctcaatgcaggccatggagcactgataagctttggagcctgcactataggaagagatagagacacctactgtatcctcttggaaaccgctgctccctgttcccacacaccacttggcctggccagtcctcatggggctgagtgtttgctctttggagtcccattagagaagcctctgaggagggagctgtccctctatgagtctcattctccaagagggtgggatttgctgctctgagcaggcctaggacacatgccaaatctttgctgcagaggctctgagcactccaaatctgaggcataaagacagtatttcacggaacaacagccttctttttactgacttcttcttattccaaggtaacttttggtaaggattatagacataaatgattgcaacagaaatgtcaatagtaaatgttattgctatggattaaaaacacaaaacaaacaaataattgcattagtgggtggaaatgataatattaggccagataattttttccactttggtaattgtagaatgcaaagataataactacaacattacaggtgggcatgaagattgggcagaaccaaaactgagtcatcattgtgaaaacctcacttcccactcaaactgtcattgcctccacatagactgaaagcaaatgtcataagtcagcgcatctctcattgtgaagtgcctgtgaatcccctgagggatcttgttaaaatgtagattctaactcagagggtctgggtccagccagagacattgcatttccacaagctcccaggtggtgttactggcactggtccgtgtgcctgaggagaaacgtccagtttctctgctctatctgctaaccatgattctcagcctcaacattaaacccttctaacatggtttgaggacctgacaatacaggtgatacaggaaggcctgggagtgcccttcctcttctactgcatacactcccacacccatgcacatactaaaaagcaagcttcctcaggacaaggacttaatcttcattttcaccacagcagttcctttcagaagagtgcccaacacatagtaaactctcagaaatatttgtgaatgagcaaaccctcacacaactctgtcagataggtattattttatctccatttttcacatgaggaaacaaaggcacaggaagttgaagcaacatgcacaagtgcacctgcccttcttccaggctcttcaccgctcaaccacattgcccttttttttttttaataactttccaactgccacctcctggagaggtggcatttctcaattgataatgcccagcatccatttctcccttcctcctttctaacagaaccctaagtttacgattccactccttccacatcgatcatatatatgttgggcaaaattaatcctttttgcaccttggacagatttgattaatctgaggtaatccatccccctttgtcgcatatttagttcagaaatagaaatgaaaatgtggctaagggattctgggagaattctcactcattcttttgacagaatttccaacagtgatcctcttctccagaatgcaaatgagaaaaccagtaactccattcagtagtgtaaactgtcttataatccaagagaaaccagccacagtatgaaatgtatggacaacaaaatggaaagaacttgagtccctgatgacatcagtaaaccactggatcaaccagccctaaagcccaccctatctcaggtctctgttatgtgattcaatgtttccttactgtttgagctagcttaagttaatttttcattttatttgaagacaaatacatagcaaatgatatataacaaccttatctctactccttcgtaaaggaagagggtgacggggagacagaatgtgaaataccatccaccagactctgactcattcctgacccttcaacttggctcccctaactgtgtttccatcatccagacttaaaccgtatgacaaaaactataccccttaaacttcttgaagaaccctacagtcatcgaaagtggatctaaataggataaagaatggtcaaaatctctcccactttacacatccaccaactactgtcttagcggacttcactttcaagatgtttaatagctctcttccttcccataaacccactgaagtattgtgaaaggatcataaaaatatgaataatctcatagcagcattagaaatccttaaagtggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggtggagcttgcagtgagccgagatcccgccactgcactccagcctgggcgacagagcgagactccgtctcaaaaaaaaaaaaaaaaaaaaaaagaaatccttaaagtgtgccataaatatctacaacatggagcaaattttggaaagtaagtttctatgtgataaacttaatggtggatcttaacaggactgaataaactaaagctccatataggtgacaaaaagacttcggaacacaggaaaacctaaagattagaagcagctatgtctgagagtggaaaaatgccatagaatcatcagagtaaagtgttcaggagcagcttttttgtgtcagtctgctctcaaggcagctgaatatgtcacattttttcagttaaagctgtgcgtctgctgtgggagactaccagaagggatattaggactagagtggggaaagtgagacagcactgcaagtatcttcaaactgcctcgaggacaaactgccttgaggagtacaaagcatgcttgctcccaacaggaacatagccagcattttgtacgcagaatcttgagtcaatgtaggaaatagggaattttacttatgctgaggtaatacacacagctattaatattgatcagtctagaccagtgattctgcactttttgtctgcgcacgtaatcactcagatagctttaaaatactgacattaagtagttgttacctttggaatggtattaactgggaaagggcaagagggagttttcctgggtgctagaaatggtctatatcagggatcagcgaactacagctcactggccaaatgggacacaccacctgtttttgtaaagttctattggaatatggacatccttactcgtttacatatttcccatggctgcttttgcactacaatagagttgagtagtttcaacagagactggctggaccacaaagccaaaaatatttggttctttgcagaaaaagttttctgacccttgatctatatctttttcttagtcatggtgcattgtgtatgtatgcatatgtatatatgcaaagattgaactgtatacttacaatttttatgctatattgtgtgtaaattttaccctaccaaaaagtgtaaataaaaagaaagaaattcaagtgcttgggtaacacgtgcagatattctcacttaattgttctctggtatggtctgcacatcagcatttgtaaaacctcccaaggtaattctaaggagaaaactcatcacaacaccagcttccatgatcacatggcagggtaaaagaatgtaggaaattgtacattgacttttaaaactttcatctttgggtgaaatatataacttcggctcacatttctttggcaaaaatcacatggccacatctaacttcaagaggtggggaagagcaatataccatgtacttgatacgataactggaatatttggtagatagcactgattgctaccccggtcttcctttcttgtcattgaatattttgtttgttctctttcatcatgcagaacccatttatctccctactcccatgagagtaatcaaaaagtcccattccatcactctttccctctcaaaacctagaatctctgagtcatgtttgaaaatttctttatcttttctgaagatgtcccctctttgtcaagagttatgaacaaaacacaaagttgtttgccccctcatatgtaacattcagtggtgaaatagggaaaggataatcacaataaacaatctcttatagagagaagaatgggaatcaaatcagccactggttaatagcaattctgacacagaaagagtcccctgcctagtggctggaaacgttccttgattaagccctaatcctggttcctggaaagtaatctccagtcactttttctctatggacgttgtctctgtctcaaagggttttcttcttttctgtcaccctccttgaccacatctggattgagcactgggaaatatatactcactgggggctgaagaactcacaacctgtttcctgtttatagtagatttggagcccaagagtcagtttaagtgtcacacagtcacagttaatttagcccaaggtcgttatctatttagtttgactcagctccaaatgccaataactacacccacaattcattttgaaacacaatttgcatattcactgtatttatttgctttctcattgtcatgtctctcacaatttaactgtggatatcaggcttctatgggagagctataccctaagttaatttctcctaaacctttttgtccaataaaacagatttagtggccgggcgcagtggttcacgtctgtaatcccagcactttgggaggctgaggtgggcggattgcctgaggtaaggagttcgagaccagactggccaacatggtgaaaccccatctctactaaaaatacaaaaaaaaaaaaaaaaaaattagcctggtgtagtggcatgcacctatattcccagctactcgggaggctgaggcaggggaattgcttgaacctgggaggtggaggttgcagtgagctgagattgtgccgttgcactccagcctgggcaacagagcgagactctgtcaaaaaaaaaaaattactgcagcaatggccctaatttggtctttcctttgagacaacacagtccattcaaagatttttacaatgatcagatggccacagccttgatctaatccttgcttggaggctgaattttaataaactgtcaccaaaaccctcctatgttctatgttttgtcttttactcactgggactgagaagcaattacctcttccaaccctgcaagttctcagatttctggactctatgttcaatttcatcactgtttgccaactagccaattcttttccgatctctgctctttctcgtaataccttgtcatattcactcaacagtaactaacatacagtaccaacattctttattctagtctcttcctctagagctacacattggttaggcagataatctgccttacaaattaatgcagtcaacaggttcagcaaatatttaagcactacgaagcctggatcaccattcttccagcctctgataacagcttaatacccatcatctggtacctcagcaaatgcacatatatattattattaatgttactgttattgttattatttttgttatggaaataccccacctacaggtactgattcctgtttcagcctggataggttacattacattgtaatattaaacaatccaaaaatatcagtggcttgaaacaacaaaatattttatttattttttatactgcctgttcaatgataaggcagcgggggagctctgcttattgtaattaccaagggaccagacttaaagaggtttagaccaatgtgggtttgcacaatcattattgcagatggaagagaatgtggcaaattgtgtattcctcttaaagttacttcatgaaaataatgttatctcttatcaaatcttcctagccaatacatgtcacatggccacatgtaacttcaaggagatgggcgtacagtctaccatacgcccagaaggaaaaccaaaaacatttggacaatagcaataatgatttaccaggataaacctggacatattttagatcagttttcaaacttcatggataaaggtaaaatactacagttttctacaaagaaagaagagattaccattaaaaatgtgaatctcagtgttatcagacttctcaggcacaatgcaagctgttagaaagagtggagtgacatctataaactgctgagggaaaaagatttttaaactagagttccctaatcagaaaaagtatcaataaagtatgaaggcataataaaagccttctcagggatacagggactcaggaaatagaaaatctgtgcagtatcacagaaagaattattctaagacatattctgggaaaaggagaatataaaatccaagccaaatataagaaatagtggagagcaagaaataaatattatagtttacaataaatagtttttataataaggctataaaatttaacaaaatttttatgtaatggtttataaaacagaaatgagatattattgaaataatgatttgaaatattcagttgagatcaatgaaaccccaaaaatatgggaagagtagaaaataaacaaaagctttctaagaatcttgtttgaggaatatgctaaacttggattaatattcttcgttgatgggagattataggtttaaatatatttgttagaagttttaagtcaacaatttgctgaatggaaataaatagaactttcaaaataataggttatgatggagggaaaaatacaatgctctatatctagcaaacatgagggaagaataaatttgtctttgtttgtgctgctataacaaaatactacagactaggcaatttataaagactagaaatgtatttcttacagttcttgaggctgggaaatccaggatcaaaaatgtcagctggttgtgtgtctggtgagggccttcttactgaatcctgacatggaggaaggtacagagggcacgaaaaggaaatgaacactgtgtcttcacacagcagaagagcagaagagcacaataagggccactctctcaagtccttcaataagagcctaatcccatccatgaaaactctgccctcatgacttaatcacttcttaatgcctatcactttggtgattaagtttcaacatgaagtttgggggacacactcagaccatagcaaaaacagaaaaataaattataaaaataattataaaaataaaaatatagaacctaaggtaaatataaaaattaaaactaagtgacaaaagttacacccagggagttccacttcttgcattgacaacatgaggagctccatggattcactccccagtgaaactggtaacaattatttttaaagcaatttaaaatatctggaaatgacctaagggcatatagcaaatgaagaaaaacatattcaagaaaatctgacatttggtaacaacagtgagagtctgtggcatctgaaccatgacccactccctttgctcttccttatcaccgtgtgaaggaaactaaattccagatgggtgtagccaagaacgtagggcagcctctcttccaggttcaagttcaagagtatggtatcttcctgggaggggctgaactttgttaaaaatgtaaactgaggcacgataaaatgttaatgagtttatttgagcaaaaaatagttcatgaagtgtgtagctctaaaccagaagcagttcaggagctccactgaaggatcacaatggggaggcttttaaaggatggacacagaaggaaagctaagaaaacctttgattagtagccaatatacagttgtcttacctggcttatcccactggaaagttcttaattatataattataagtttgtttgctacttctgattggttgatcttaagttatgtttctcttcactataggcatttacaagaaatagcaaggcttttgtcacttatgaggcctaactgcttttgtctgttcaggaattattcaggcctggtctccattttaactttcttttacaacatcaacatttctgatcccatcctaggctacctattgcagagcctaagttccaggacatgcaattgagaagtggaggttccctcatgggacagaaacagcttagagaaggagagggagagagagagacggagagagagagagagagagagagagagagagagagaaacttcttttgcttgggagaaagtaagggaagagaacaaaagtttctgcctggtaatccagagagttcttccagatcttatccaagacgaccaagtcagtacgtctaagagtatgcaggagccacagtattactaggcttggggtatcccataatgcagatacagctgtggtgaccaaaaagttagattataacacccaagttcctttcaaatacctggaaagacttccaaataaggatggatgcaagtaagcccaaattgtgaagactacatagaagaaaagagagaagaaacaaatagacaaaataagattgaacaaaggcctaaatgtaaaagataaatcataaaaatcttagaagaaacaacagagaaaatcaataaacccaaatctagttatctggatagatcaacaaaattaacaatcttctagtgaggctagtcaagaaaaaaatagaagactcaaattacaaacatcggaaatgaaaaagtgataatctttaccaaggccatggacattaacaggataatgaaagaatattatgacaactctaggtctacaaatttggtaaattagataaaattaccttaaatgatacacactacaaaacctcacacaaagataaaaagataacctgaataaacatatctgcaaaataaattgagtcaataattaatatatttcccaaatagaaattactaggcccagatggcttcactgttgaattctaccaaacgtttaaataatgcttaatagcaatctacactctcttccagaaaatagaagcagacggaacactcctaactcattctgtaagaccactccataacaccaaaaccagttaaagatatacaaaaaagcaaaattacagaccaatatctcttatgaacatagatccaaaaatcttcaacaaaatataagcaaatcaaatccaacaatgtataaaaataattatacatcaggaccaagtgagacttattacaggtatgcaaggctgatccaacattcagaaatcaattaatgtaactcatgatgtcaacaggctaaagaaaaactaccatattattatatcaatgtatgcagaatattcatttgataaaatccaacacacattcatgataaaatccaacacacattcatgataaaaataatctcagcaaatgtggaatcaaaggggacatcctctacttaataaagtgcgtctacaaaagcccagaggtagtattatacttaaggattttgagaaaccaggaaaaaagcaagtatgtctcctctgacaacttctattcaacatcatattggaagtattagctagtacattaagacaagaaattgaaataaaacatgtgcttcgggggaagaaaaaaactatgcctctctttgtccactgaagaaatgtttatctgtgtagaaaatgtcatagaattcatgacaataacaaacacaggacaacttttaaaccaaaaggtgattataacaaggtcataggaaacgagattaatataaaaaataaattgctttgtcaaatactgtcaataaacaattaaaattttaaattaaaaacatcatttataatagttccccccaaacaaaatacctatgtgtaaatcttcaaaatacgtataggctctgtatatggaaacaacaaagcactgataaaagaaatcaaagaaaaaataaatggaaagtcattctgcattcatgggttggagacagaaaattgttagtatgtcagtttttcccaatatgttctgtacatacaatatgattccaatcaaattctcatcaaggtattttctagatatcaacaaactactgtatattttatatggataagagtagctgagcataggcaatacaatatagaagaacaacaaagtcagaggactcacattacttaatttcaagacttactataaagttatagtaatcaagacaatgtggaattggtgaaagaataaaaacatagataaatagaatagtgtccagaaatagaaccacacccatagagtcaatttatttctgacaaaggcgcaaatgcaatttcatgaagaaagttaatttttaaaataaaatataaaatgaatccagacaaaaccttagacctttcactaaaaactaatccaaaatagcttgtagacctaagcgtaaaatgcagaaactatataaaatctctaggagaaagcaggagaaaatctatataaccttggatttagtgatgagttttcagattcatgaaagacaaattggtaaagttaagtatcgttttaaaaatgtgtgcactctgtgaaaaacattgtaaagagaatgaaaagaaaatccacagagagaaaatagttgcaaaacacctaccaaataaggcacttgtatgcaaaatacaaaaaacttaaaactcaacaattgaaaaccagaaaactcatttaactgggcaaaggtttgaagcagatgcatcaccaaagaagacaggtaaaaaatgagcataggaaaagatactgaatattatttgttattatgtagtttcaaattaactaacaataaatactactacacacctactggaatgtataaaatttaaaaaatacgagtccaattgctagaaagaatgcaaagaaggaactctcattcattgctggttgaaatgaaaaatagtacagccacttttttaaaaaaatgtattattattatactttaagttttagggtacatgtgcacaatgtgcaggttagttacatatgtatacatgtgccatgcggtacagccacttttgaagacagtttgtcagtttcttaaaaacactaaacatagtctcaccttagatccagcaagcacgctcctgggttattttcctaactgatttgagaacatatgttcacacaaatccccatacgtaaatgtttatagatgcttatttggcaatcaccctaaagtggaatatgtcctttaatggatgaatagataaacaaactgtgacacagccttacaatgacatattattcataaataaaaaagaatgacctacaagacatgcaaagacatcaaaaatattaaatgcatattgtcacatgaaagtagccagttggaaaaggctacagagtgtatgactccatttatatgacattttggaaagggaaagaattatagaaacaataaacatacgtagaaaagtgtaaaaaggttaagcacaggagatttattagggcagtgaaactatttttatgatactgtaatggttcatacatgacagtatgtgtcaaaaatcataaaactttatagcacaaagagtgaatcttaatgtatgaaaattaaagaaataatttaagagatcaaaaaattccaggatgaaatgtagaatatagcaaagcattctaactgtattaaaaatgtatgaaacaatctcattgaagggcatgatgggaatttgctgccttaagtaacttggaagtgagtgttgtaaagctaaggtcaaaaggaactgtatgtaagtgctgtactagagttagtaaagttgtttcccacaggagtacagattaataattctgaaaacagtatacatgtatattggaattgaacagttaactgaatggattgacagatgacaggagatgagtttctcattgttagaatgggacgtcacaggtaagcaaggggaggaggctagaataatctttgttgtaatggattagagttggagacgtcagcataaagtcatgttcggtttaatatagttacagatggttacatatccaaatatttataggtgtgtgtagacacacatatatatttcattgctctgtgaactgagaaaggctataagtaacaactcccccagtagcaacaagcccacctagaactaagatgtgagtttctaaaaccatcatctagtaaaaataattagggctccttggagaaatggctgattctgagactggggcatgaaatacagttgcccctctgtggattccacatccatggatttaaaaatccaaagatcaaaaatacgcaaaaaaaactggatctgttcataacatgtacagacttttattttcttgtccttatgccctaaacaatacagagtaacaacttttttacattgcatttacatcatattaggtattataagtaatctagagataacttaaagtatatgaaaggatgtgcacaagttatatgcaaatgttataccattttgtataaaagattgagcatccgcaaattctggtgttcatgggaggtccttttaaaaaaagttttgtgggtacaaagtaaatgtatattttatggggtacatgagatgttctgataccatggaagttcctgaaaccaatcccccagggatgctgagggagaactgcatataaaatgagcctggagcattttgtagtgtcagaaagtaagatctgaaaaacttcttaagggacaccacaagtgctgcattgagcaaaatccatactatgggaaactagacaaaatacaagacctgtttatttttttgttttgtcttgttttaagttgcaaggaaaaaaagattaatagtcagagaaattatagattaaaaaagactaagcgatataaccaataatttcactgattagatcatatttaaacactgattcaaagaaactaatttttaaagtatatgtctgccaggtaaatatggaaattatctgggcatttgatgattactcatttaaactgttaggaaatataattacattgaatttatgtttcacaaaagagttcttatcttttataaaagcatatgaaataattagaaacaaaatgatatgatgtctgggatatgcctcaaatcattacggtagcaagagatggaagtaggtaagagtaaaattagaaccagattggacaatgtattgaaaattgttgatgctaagtgtctggtatattggttcattatactattctctttactgtcgtatatgttgagaatatctgtaataaaaactttttattgtaaatatcatgccattaaatttgaaatcctaagtgaaattgatcacttacaggtttaatcaaacaatacaaactgaaactgtacagtattcaaaactcaagccactgccaaatgttccaggataaggcagtttgggaggccagttataccaaatgatcatggagaaacaaattaccatcttatgtaaactcttccaaagcatacaaaaagatgggtaattattcaactcattttgccaggccagcactctttgattcaaataccagatgagagcaaccagtgaaaagaatgcttgagccaagctctctcacatagcagcaaatattctaaataatttaatagcatattcaacatagaagtatattaactgaacaaacaagctctgtccaaggaataaaaattatgatttaacattagaaaatgcttttaattgtaattccctgtaaacaaattagaggagaaaaaacacttgattatgtcaatggctacataaaaagcatttcaaagaagtttaacacaagataatggtaaaaaaaaaaaaaaagtaaactaacattagaatagaacttgcattacttaaaatctatagcaaacgcacttaaatgtgaaatgttataagaatttccataaaagccaggaacaagacaaaaatgtatgctaccttctctactgttcaaaactgcactgaaacacatagccagagctatgggtatcaaactaaataagatgcatgaattttgaaaagagagatgtttggagacaatgttatctttaacgaatagtcaaaggaataagcatgtggaatatttaaatgaataaaagacttcagaagaaaaatgttttatggaagctcattatagcaaaatcaagaaactggtcataaaaaaacagtaaatagaacatacaatagaaaatatcccattaaaaacagcaaaaaactcctaaaattaccttaaagataatcctaacaaaaatgagcaggatcttactggagtcaactgtaaaagtttgctgatagattcaggtgaaagaagtcccaaataaataaagcattataccatatccattaatggagaacagaatattttaaaggcgtgaattttccttaaattatttacagaattagtgccttacctttaggccaaaatgagcatcaagttcatattgctgacttacactccagaatcaatcctggaggggagaagggaaaaaacattatcaacactcaacaaattctacacagcaaaacatgatagaaccctaagcagactgcagaatttcgaattggaccttgtgtttggagtagggggagtggaggacaacagtgcatttgcggaggtccgcagcctgcatagacggcaaataagaggacgagtaggaagaaatatttgaatttctggccctgctttattgcacaatctgaggcaacacttcataccacgatgccagtagcccagtagctctggagtgatatcaggacagcaggaaagacggggttgattgagggagtatgactccggagtctatgctgctaaccacctaaaaccaccacagtgacgactggtcttagttgatcctctgctacaagttaataattctttatattaaattttcttgctcagaaaaaaagagaaaaattattataatagaatataaagaatagaccagaaatagaataagcagtgaaccacacagcgtaaggtaggtattctttcatgaaatgttatatatgtattcaatatacacttggcagacatttaaaacacatatttttactaggaatgagggttagaaaaccagacatcactgcattggactataaaatatcagctaaactcaaaacagcaggacctctccacaccccgatgctcagcctctttcttgtagaaaatataccctttaggacaaaaagtttgccaagtctacttgtggcttgggaagagccccgttgggaaggtgtgcgtcttctcccataggtcattacaatcacgggtgttgcagctccccagggaccatctggcctgggaaccgcacccatgctctgcaagggatgcagctgggcaaatgatcagaggtgacggaaactgagcatctcccacccatcacttcatcaaagagacaaaagccaggaggaagaccctcctgagtgaggaccgagggtccacccacccctcacaaaggggccacagaatccagctgagcccctcttgtcagccctggaagaccctggcaatgttgtcacccctaccacaaccctcccctcactgccaccttggaagactccgagtcaagagacctggtttaaggggagaagacatcctcagcacaaaacaggggtccaggcttttccaggcatcaaggtcgagacactgagggatgactgaaagaccccacccccacccccaccacgacccacagccccaagatccccatcccagttcccacctccacgcccctccccacactcatcttcaccaccacccctgccccaaccccatcctcacccgtaccccaccccacccggactcccaccctcactcccaccccaactcccaccccagttccggcagaatccactccgcccctgctgtcaacccagggaagccccggggaccggatgtgacgccactaacttacgcctcggggatcagagagaagcgaggttctcgttctgagggacaggcttgagatcggctgaagagagcgggcccaggctctgtgaggaggcaaggtgagaggctgagggaggactgaggacgcccccaacccagatagaaagccctaaataatacagcgctgcctctgctgccagctctggaccacctgagggcagacttctcaggctgggctgtcaccccccccccacccccgcccccactctctcccgccgcttaagccgcaggggactctgggagtcagagcttggtgtgaccagggcccggctggttcggcgggagccgcgcctaggttctgccagcatcaatgtcgggacgctcagggagggctctgcccctgatgtcggccctgggaagccctggtcatggcgaccaggaacgcaaattctgacgtcggcatctgaggctgacgtagggaaggggatattggtaccaagaatgcggcttcaggggagcagagggaaggcccgggccctgctgggaaatgagggaggcatgaagggatcccaggacagggtgcccaccccacctctgtctcagaccgagatgtctcttcactcggcctgaggaatccaagggacggtgactcaggtctgcggcggggcgtggtagaggagaacaacccagccaagagtcaaggggaggaagaagagaaaggactcaagggaccttggagtccagatcagtggggacctcagccctgggtggtttcaggcacggtggcccatgtgatgtgtctttgctgtgcctttggggtgtcaatgaggagagggctatggtctgaggagtggagcctcaggtcagcagagggaggagtcccagagccctgagggaggactcagcagatccccgcatctcagaactaggaaatctgtccctcttatcagctctggaaccccaggcaggacggtgaggaagagaagtggcccccactttctcaccggggatcccagggagatggtggctttggcgtgcaagacccatacacgattcagcaggagggaaagggctgggccctgtcgggagtaaatctgaatacctggaggacacccaaataaaggaagtccccgtcttgtccccctcccctgcccaccacccccccccccccccccgccaaatgtctgctccttctgtcagctttgggaatcccatgcaggtgtgatcgtgtggtgcccctccccacttctgcctgccgggtctcagggaggtgaggaccttggtctgagggttgctaagaagttattacagggttccacacttggtcaacagagggaggagtcccagaatctgcaggacccaaggggtgcccccttagtgaggactggaggtacctgcagcccagaaagaagggatgtcacagagtctggctgtcccctgttcttagctctgaggggacctgatcaggattggcactaagtggcaagctcaattttaccacaggcaggaagatgaggaaccctcagggaaatggagttttggtgtaaaggggagatatcagccctggacaccccacagggatgacaggatgtggctccttcttacttttgttttggaatctcagggaggtgagaaccttgctctcagagggtgactcaagtcaacacagggaacccctcttttctacagacacagtgggtcgcaggatctgacaagagtccaggtaaggaacctgagggaaatctgagggtacccccagcccataacacagatggggtccccacagaaatctgccatgaccctactgtcactctggagaacccagtcagggctgtccgctgagtctccctgtcttatacaaggatcactggtctctgggagggagaggtgttggtctaagggagctgcactcgggtcagcagagggagggtcccagaccctgccaggagtcaaggtgaggactgaggggacaccattctccaaacgcacaggactcagccccaccctaccccttctgtcagccacgggaattcatggggaactgggggtagatggactcccctcacttcctctttccatgtctcctggaggtaggaccttggtttaaggaagtggcctcagatcaacaaagggagggtcccaggtcgtatcaggcatcaagaagaggaccaagcaggctcctcaccccagtacacatggacccagctgaatatggccacctcttgctgtcttttctgggaggacctctgcagttgtggccagatgtgggtcccctcatgtcttctatttcgtatcagggatgtaagcttttgatctgagagtttcttagaccagcaaaggagcagggtctaggcttttccaggagaaaggtgagagccccacgtgagcacagaggctccccaccccagggtagtggggaactcacagagtccagcccaccctcctgacaacactgggaggctggggctgtgcttgcagcctgaaccctgagggcccctcaattcctctttcaggagctccagggactgtgaggtgaggccttggtctaaggcagtgttttcaggtcacagagcagaaagggcccagacagtgccaggagtcaaggtgaggtgcatgccctgaatgtgtaccaagggccccacctgctccaggacaaagtggaccccactgcatcagctccacctaccctactgtcagtcctggagccttggcctctgccggctgcatcctgaggagccatctctcacttccttcttcaggttctcaggggacagggagagcaagaggtcaagagctgtgggacaccacagagcagcactgaaggagaagacctgtaagttggcctttgttagaacctccagggtgtggttctcagctgtggccacttacaccctccctctctccccaggcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcatagtcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatctaaaaaaaaaaaaaaaaaaagttggtatcatggaagtagagagtagagcagtagttacattacaattaaataggaggaataagttctagtgttctattgcacagtaggatgactatagttaacattaagatattgtatattacaaaacagctagaaggaaggcttttcaatattgtcaccaaaaagaaatgataaatgcatgaggtgatggatacactacctgatttgatcattatactacatatacatgaatcagaacatcaaattgtacctcataaatatctacaattacatgtcagtttttgtttatgtttttgtttttttttaatttatgaaaacaaatgagaatggaaatcaatgatgtatgtggtggagggccaggctgaggctgaggaaaatacagtgcataacatctttgtcttactgttttctttggataacctggggacttcttttcttttcttcttggtattttattttctttttcttcttcttctttttttttttttaacaaagtctcactctattgctctggcaggagtgcagtggtgcagtctcggctcactgcaacttccgcctcctgggttcaagcgattctcctgcctcagtctcctgagtagctgggattacaagtgtgcaccaccatacccggctaattttgtattttttagtagagatggggtttcaccatgttggccaggctggtctcaaactcctgacctcaggtaatctgcccgcctcagcctcccaaagtgctgggataacaggtgtgagccactgcacccagcctcttcttggtattttaaaatgttgttacttttactagaatgtttatgagcttcagaatctaaggtcacacgttcgtttctgtttatccagtttaagaaacagttttgctattttgtaaaacaaattgggaacccttccatcatatttgtaatctgtaataaaataacatggaattggaatagtaattttcttggaaatatgaaaaaaatagtaaaatagagaaaataattttaagtgttagtatttttatttctttattatttttagtttatcatcctgcaaaattaaaagttatatccctggatcttgttaagtcgaaattaaactgtaataaatgaaacctttgctcactagtgcattttttccccaaacatccactgagcatctggtctgtggaaggccctgggtctgtagtggaaatgttaagccagaaccacctttacccatagggtggtagagtctaggggctgcagtcaagtaacaaggtggcaagatgtcctctaagacccagaagaaaagtaagacggggtgagggtattgggctgtaggtgagagtggtcacgtacatcctctgagccaggacttttggggctttgagaaactgcagttccttctggtgaagatgaatccaaagaagctgggtggtgccagggtcagagcctcacatagttgacagagcaaatcctgggatgtaaaactgctctgagcagttccttttgggtggtggatgaacagagaggagtccacctggggcaggaatggaaggtgttctgcactcttgtctcagtgcagttgaactcctaattaaattaaaaaaataactaggtgatagatacccatcatatgcaagggtctcctgagagataaggatctcataataaataagcctatgaattgatgcctagaagttagctgactccattagagaaacattttaattgggttatttttagtgtaatttgaacaacactaagcaagggctagattttgagtggtgatgaaatgaatgaaaatcatgatttggatggaaaagaaccttggagagagggaaggagttgatacttgactcaaattccatgaactttgagcagcatccagcagggagaaactcctgcacatgaaatgttgaaaatatatcctctaagagggaaaatttactgagttttatatgtgaagcaacatttgtgactgatttgggattccatgttccactgagctgcatattctgagatgtactggataacaatgacaaaaattccagagaagactgtggtggggtctgaggtcaaataatattagaaataacagccatctgccattcattaaacttctaactatgccaggccctgagccaggttcttcacttatattgcacacactccagtagtcctaatggacagggcttatcacacctgcttcacagataaagaacccaaggctcacaggacttgggcatttcccagaatcacatggctagtaaggaatagggctggaaccagactcctggtgggtctgaattcctgtagagcccatgctgttcccactcctcccagcctgaggccgacctcttgaatagtacttcatttctcttctcagcactgtaccatgtctctcaggtgacaaaaatagggactctgaggccaaggtagcagtcgtaggcctagagaaggtgacaatgagaatcaaacaccatttcagggtggcctgtggaccttattaatccagggacctactgtgtcaatccccagggttccttgagagctgactgtacccaggagctggcatttctgttcagagccagcacttccccacattacagcacccttcccctggttgtccccagtgttccctcctacccaaatctggaacttggattgctgcctagcttgtcactgtggtctctgctaaaggctgtgcccagaacacagtagagaagcctagaatcgcctgctcaccctgtgacacagagcatgcctacactctgcagaagtactctgagtgttctgtcccattcctggaaatctctcttatagcagatgtctaaatatcagtgcccaaagtcaaatttatgtagaaatttatgttgaaagggcctttcaacttctcctctgctttcaaaggatttagtcaggagccggggaaggagagcagacaggacaccctcggctggcaaggggcattaggaggatgcagggaagagcaattaccagagtccacgagagagaccacatgtgaaatcaagtccacagagccccaggcaggctgccactgagagctctgaatccagatttcagcccggtgggggcagagacctgagggagagaagtgggaagtggtgaaggaggacacggcaacaaacagggataggcttgagaaatctggacactatcatcatcaacaggatgtggctgtgtgatctgaatgggcaggcctgttggctgaatgcatcagcggcatgttggacaccttatgctcattcaagattcccctccctctgtcaggaagagtatggctggctccctgcatcattctgggtgagctacctctcttgaccactccagtggtcctgtgcacccttgccagcatcccagggctgggacctgtctttatgcctacttgagctgatgaattatcccctggggaacctccatagaggttgggctatgtgtgtgggttgctgactgatgatcaacagctgagactcaccaggaatgccaatgatcagtggaaggtggtagtggggctgcatggaggggaaattggaggaaaagtgacctgggactaatcagctcagactctgcagatgaagggcttgtgtggacatgccttgaaaatgatccagctggtgtccctgactcagatggcctcctgtgtcttctgagctcttggcatacaaggggacaggtgtcttgggactgcaatcactggcctgtgttgccaccagacactgtctggggtagagggctggccaaaggtgtggacatgggcaagttggatggaaaccctgtgaagatggcacccttcattgttaaactgacagaacatgtgggatgcaatgcaaaaagctgaaggggtgggttgcccctccacacctgtgggtgtttctcgttaggtggaacgagagacttggaaaagaaaaagacacagagacaaagtatagagaaagaaataagggggcccaggggaccagcgttcagcatatggaggatcccgcaggcctctgagttcccttagtatttattgatcattcttgagtgtttctcagagaggaggatgtggcagggtcataggacaatagtggagaggtcagcagataaacacctgaacaaaggtctctgcatcatagacaaggtaaagaattaagtgctgtgctttagatatgcatacacataaacatctcaatgccttaaagagcagtattgctgcccgcatgttccaactccagccctaaggcagttttcccctatctcagtagatggaaaatacaatcgggttttataccgagacattccattgcccagggacaggcaggagacagatgccttcttcttgtctcaactgcaaagaggcattccttcctcttatactaatcctcctcagcacagaccctttacgggtgtcgggctgggggatggtcaggtctttcccttcccacgaggccatatttcagactatcacatggggagaatccttggacaatacctggctttcctaggcagaggtccctgcagccttccgcactgtttgtgttcctgggtacttgagattagggagtggtgatgactcttaacctgcatgctgccttcaagcatttgtttaacaaagcacatcttgcaccgcccttaatccatttaaccctgagtggacacagcacatgtttcagagagcacggggctgggggtaaggttatagattaacagcatcccaaggcagaagaatttttcttagtacggaacaaaatggagtctcctatgtctacttctttctacacagacacagtaacaatttgatctctctttcttttccccacaaaaagcatcatgcactatcctgttgggagcatcctcacctccaagacactgtttgggcctgaggagaaggagtctgcagtgaccctgtcgtggtattttccacaagaattctgaaatgaagcaagcacaggtaagggaactgtgggtttcttcatggaggcaggaggcccacacaggggcaggctccacactttgaatcagtgaattctcatgcctggtaatttcattcattcattcattcattcatccagcaaacttttgttgaatacatgctgaggaaacatgaggtaacaaaacaaagtgataaggcccttaatccagtatgtgggggatgtaggggagatggtgaggtggtatgagtcactcatttgagccagggaggccaggaaggcagagccagacttggaggcaggccttacacaagaaagggagggacagcctatgaccaggccagtaagctggccttctatgacactattgatctgattttcttcctcaatgctgcctgtgtgtgaaagcaactgccactttctgtgcccacctgcctttgttaatagggaaagtgctcatggttggcagatgctcacttctgctcacctcaggtcacttctactgaaggagtggttttactgcaaaagcacaggaagaaacttttggggatgatgaatatattttgcgccttcactgtggttgtgatttcatgggactatatatttgtcaaaactctctgaattgtttctcagtatttcagagaaaaagtaagcaggaaaccaggaaggatatagattacctgattaaaattaaaaacaaacaaacaaacaaacaaacaaaaacaccgcatccaactatagcagaataaacattcctctcaagtgtgcataaaatatttaccaagctagatggtattctgggccataaaacaaaccttacaaattgaaaatattagaaataataaaaagcatattctttaagatgcttcttgaagaccataatgtagttaagctcaaaatcaaacacaaagataactgaaaaatgctcaaatgttgtaaattttaaaatatgctcctaagtaatctatggatcaaagagggattcttaggataattttagaatatacattacattgaatgaaaataaaaatatacatacaaaaatttgagggattcagctaaagtagtccttgggaaaaatgtatagcatattttaaatatttatattagaaaataaaatataaaatcaataaccaaaactttcactctaggaaactaaagaaagaagagcaagttgaatttaaagaaattgaagaggatcccaccttcctcccttcccaaactcccacctctcccctccttcctccctccccaccatcctagaacacacacacacacacacacacacacacacacacacacacacacaccccattttacaacaggttctttttattttgatcaccgtggggtgtaccctgtggggtgtaaaacgtactctagaccctgttggctatttatttggggttagacctctggagacttttcaggtaaatctgagttctctggtcttgccctgaaattactggctgcccggggagacactagggatgttggaggtctccttgctttggtcctgctgtggctaattttgattaagttcctcattcagctggtcacaggggctggatagttttggctcgcttccttcctcaggttttcttgaagcagagatcttttttgggagagttgttttttttttttctggaattccctaaaaggtttccttttcccttcctggttgtcttaggaacctgaaaggacaacagggagatcacagaaggggactgattttggggaagagaatggaggaggggtgggaacaggggcttcaggagaagaggtactggctgaggtgggggtagggtaggacagggtaggagtcttgggagggaggagtcaaggggaagactaagaggagcttctctcaccttgataggacttatagacttagtttgacagggggccttcctgttccttgcccctttggtgttggcaggtggttgttctttgacacctgggctggaggtttgtggtttcctggtcatcttcaccatgtcagtgtctctcaatcgtctactccatgcctcctggcctccctatatatacacccccttccaccgtgacaataaagccatacctgtgagctttgatggatcagcaagccactacccagccaatggtggctctgaggggtgaggggcttagacatcacaaagcactataaggacattgtcgtgagtgggaggggggaaggggtatggagagagggaagaggggagtctgatgacaaagccaggatgctctgattgaagaaaaaggggacatttctttagcactcctaaagagctttcccaaactgagtagcggtgctcctttcctcccatgttcaacttgggtgggtcacatggcagggagagagtatttcctctaagccttttcccaaagtcaccccacttcagtgcttccttctgttttctcccaccattatctagtttttgtacatcttaccggaaatctctccgaggtaatctgactgtatttaaatatatgtgtagatgtgaatcatcctacttcactcctaaaaatttctcttatgcatcttgaagaccactcacttggataccaccaaggaactttcccatcctaccaatggaaaagtgtccacagaagtctcctggggtttcagttttccccagtctgaaatcactgcattcaggctgtcaaactccagtgaatacatttgctccactggacatcttatgtgtcttgtttcaactgtagggttatgctcatctcagtagatgtggtacccaggcttggattttaacagtgtagagtgaatgaggcagattttcatgccagaaattacgcaggatatttgcatgtaggaaactaaaacctaagactgacgagttcatggaaaagggtggtgttgagaagaatagttcaacaacgtgcctgaggttctgtccagtgtaataagtttttttaaaaggccttcgtattggaaagggacaaataaaactgtctttatttacagaaaataagagtatatacggacaattctatctatcaaaaaaatgcttctaaaactaataagagtttagcaatgttgctggatatagatcattatacttgtgtttttacactagcaatgagcaattggcaactgagacaaaaacaatgcaatttaaaatagcattagacaataaatattaaatggataaatatgacagaagatgtataagatctatccattgaaaactataaaacattagagagataaatttaattagaatctaagtaaacagagacatacactttattcatgagtcaaaagactgaatattaagatgtcatttgccctcaaagtttttgacatattcaatgcaataaaaatcaaaattccaggatttttaaaatataaattgagagactgactctaacattcatatagatgtgcaaaggccctagaatagtcaaagaaaactaaaaaatagaacaaagttgggggagttaccctacttcatttcaaggcttataaactcgcaatgatcagtatagtgtggaactgtcataattatagcagtatatcaatggaagagaataaagtccaggagtggatccacatgtatatgtatatatagacaactaattattgataaagatgcaaatgaagattagaggaaagaaatgatagtatattcaacaatttgatctgaaacaattggatatccatatgcaaaactaaatttcaatccatactctatctatctatctataaagggagagagagaaagaaagatattttaaggaattgtctcaggtgactatgaggtctgatacatccaaaatctgtaggacagggcagcaggctagaaactgacacagcgtttttacgttccaatcttgtggtagaattccttctccaggaaacctcggtcttttaagaccttcaactgattggatgaggcgcacccacgttatggaggtaaactgctttacttaaaatcgattgtaaatgttgatcacatgtacaaaataccttcacagcaacagctaggctagtgtttgaccacacaactgagtactatagcctagaaaagctaacacataaaactaaccattgcacataccttgccccatacaaaaatgtaactcaaaatgaatcatagccctaaatgtcaaaaatactttttttctaggagaaaacagaagaaaagttttataacctgtggttatgttttagtcagctttggcttccataacaaaatggcatggattatttagctgaaacaacagaaattattttttttcacagttttggagactaaaagtcacagataaaggactggagggtcagtttcttattcccagcttgtagatggcccattctcattatgttcattcttgtcctttcatctgtgcatgtgcatggagagagggagaaagggaaggagggagggagaaagggaaggagggagggagggagggagagagagagagagggagggagagagtgagagagagagggagggagagggtgagagagagagagagagaactcatgcaagcacaagagtgctttcttgcttcccttataaccacactaatcttatgggatcaaggccccacccttatgacctctttcaatattaattacttccttagaggccccatctccaaatacagacaccctggagctgagggattcaaaatatgaatgcggtagaggacataaccattagcaaagaataaacacatagattaataaaacagaatagagctcagaaacagactggcacacatatagtcaggtgaattgcaacaaaggcaataatggtaaaagtatagttttttccaacaagtggtgcctgaacaattggacatctagacacaaataataataataataataataataacctagacatatccttaaaaatttcacaagatcaactcaaaatacgtcatagatctaatgcaaaatgcaaaaaccatacaacttctagaagaaagcgtaagagaaaatctacacaaatttgagtttgatgatgagttttaaaattcagcaccaaaagtatcatcaatgaaggaaaaattagccaagttggattttattaaaataaaaatcttatgctcttcaaaaaacagagttaacagaataaaaacagaagctacagactagcagaaaacatctgtagcacacatatgtgataaagaacttgtctctacaatatacacaacttcttaaaactcaacaatagaaaataaacgaaaatagttgaagatctgaacagacagtacaccaaagaagatatacagatggcaaataagcatagtaaaagtcctggacgtcttttgtcattagagaattgtgtactaaaatgagaaaccactatacacctattagaatgtctaagataaaaaaaagaccaattgctagtgaagatgtggagcaacagaaactctcattcattgatggtggaaatgcaaaatgatgcagccactttggaagtagacagtttggcattttcttaaaaaaactgaacatagtcttacgataagattcagcagtcctacgcctaggtatttacccaactgatttgaaaacttacgcctacataaaaatttgtatgtgaatgtgtacaatagcttatttcataatcaccaaaaatagaagcatccaagatgtatttcttttggtgaatggataaagaacatatattaaaaaaacagaatacagcccagaaatagacctgcacacatatattcaggtgatttataacaaagcaataatgctgaaagtatagttgttccaacaaatggtgcatgaaaaattggacatctatacaccaacaataataataataacctagacaaatccttaggtatttcacaaagattaactcaagctacatcatagacctaatgcaaaatgcaaaaattatacaacttctataagaaaataagagaaaatttacattactttaagtttggtaaaaagtttgtaaattcaacaccaaaagcaaaagtagcaatgagcacacctagcacccagatgtaaatttctagaaccatttcctattaaaaggaaccagatctctggagaaatggctgattttaggactggggcagggcataaacccaatgagcctagagcatcttgtagtcctagaaatggagggctaaagaatatgataaaggacatcacagtgttgtattcagccaaatccagactatggaaaactggaaagaacacaagatctgtttctttccaacaacaacaaaacagtggcaagaaaacaggtcatgtggaggggacctacaaatgatagaagacttaaggagtatgaccaaaaaatcactatataatattatacttgggtactcatacaaagaaacacaatttttataaagtataagtctaccaggtaagtgtgtaaaacagttgaacatttgataatcatttatttactttttagaaatgaaaataatattgggtttttgtttaatacaaagtccctatcttttaaaaatatcatattgaattatttagagatgaaatcgtatgatgtcttagacttgctccacgttactccagcagcttaggtgctggtaggtgagtgtctaactggaaacaggtttgccgtgtagttaaggttattgatgctgagagtcatctacactgggttcactatattagtctctctattaatctgtatgtttgaggctttccctaataaaacattttttatcataaatatcattccactaaaagttaaatcataagtgaaactgatcactttgtagaaataaataaataagtgaccaagtgaccaaattgatccaaaaagaaaaccttaattaaactttacaaactgaaactatacaagctcaaactattcaaagctcaagccaccctcaaacgttccatgttagtcagttttggaggccgattctactaaataatcaggggaaactaaccaccatcttatctcagctcttccaatgcacacaaaatataggcaattgttcactttgttctcccagatgagccctcttggattcaaaaaacagatgaggaccacctcccaccccgatataaaaaacacatcaagcaagctctgttacatagcagcaattattctatgtaaattagtagaatattaaatgaacaaacaggctctgcccaaggaaagacaatatgattccacattaggaaaaaaagtttcattgtaattctttacatacaaaatagagtagaaaaaaatttgattgtgttaatgggtacagaaaaagcttttgaaagaaattcgatgagttcatggtaaaaatatttagttaacctatattgaaagataacttctatttcctaaaatcaacagcaaacatacttaaatgtgaaacgttcaaagaattatcattaatgtcaggagcaagaagtagatgtaggctattatctctatgttttaaatcatcattgagacacaaagtcagagctataagtatcaaaataaataagggttgtgaatattggaaaaatacataatgtttagtgataatgtcattatcggtcttgaaaattcaaaggaataggcaaatggaatattcaggtgaatgggctttcagaaagaggtgtgtaacattactatagcaaagtcaaaatctttgacatgcgaaagcaatacctaattagaacaaacaatagaaaatatgccatttgcagtagtaacaaaatccaagaattaacctgaaaagaaccctaacaaaaatgtataaggtctttctagaggcaactatcaaagtatactgatagattcaggttaagagggtctgaaataaagaggagcataacctgttcattgatggggaacagaacattgtaaaaatgtcaattatacttaaattatttacaatttagtgccttacctgtagccgccaaaattacaatcaaatttgggcggctattctctgcttcccaaatcaaccctggaaaattatagaagggaaaaagaaagaggaaaaaaaaaaacaatatcagcaataaaatctaagcaacaaaacagagaaaaccctggatgagactgaagactgtgttgaactggtacttgtgtttgggacagtgttggctggaagggggtcagcagcagagatgtaggggaggtctgcagcctgcctatacggcagatgactgaacgaataggatgaacatttttaaatttccacctcacttcattgcacaatctgaagcaccacctcaaaacacaatgtcagtagccccagagtaaaaccagaactccaggaaaactgtgttggttaaggcagtgtggctccggaggtctgctaataacgatctgtaaccaacatagtgggaaaggatttgcgttttaaaatattgtttcaacagaatataaacaatggaacagaagcagaatagaatgtcagagtgaatcatgcatactaagggtacgtattctttcacataaataaatatatatattgctacctacatatatacttggaaaatatgtaaaacatatttctttgatggagagaatgaatcatttaggacaaaaagtttgcaaagtctagctctggttggggaggaaccccggtgagaagatgtgtgtcttctcccagaggtcattacaatcacgggtgctgcagctccccagggaccatctggcctggtacccgcaaccatgctctgcagggggtgcggctgggcaaatgctcagaggtgacagaaacagagcatctcccacccatcacttcatcaaagagccaggagccaggagggggactctcctgagtgaggactgagggtccacccacccccacagtgaggggccacagaatccagctcagcccctcctgtcagccctggaagaccctggcaatgttgtcacgttgaccacatttctcagagtcagaaacttggtctgagggaagcagacacaatcaacagagaacaggggcccaggctctgccaggtatcaacgtcagcaccctgaggaatggcaggcttccccacccccactcccacccccaccacgacccacagtgccatgatcaccactgccacccccaaccccatactcaacaccaagactgccaccccgcaccgccacccccacccacattaaggcaggatccggttccccgctttctgtcaactcacagaagcgccaggtggcccggatgtgatgccactgacttgcgcattgggtatcagagagaagccaggttcttggtcttaggagcagcttgagatcggtggaaggaagcaggcccaggttctgtgaggggttaaggtgagacgctgagagaggactgaggacacctcaccccagatagagagccccaaataatccagcaccgctcctgctgccagccaacttctcaggcagggccgcccccagccccccgtggcttaagccccagggtactctggagccagagcctggtgtgaccaggaaagggctggttagaagaaggcagcgtccaggctctgccaggcattaacatcaggaacctaacggagggctgagggcccctcttccctattcccatcccctaccacatccccattcccatcttcattcccaaccccatcatcacccccattccccaacagcaccctcatcctccccagtccccaccatcttcatccctcccccatccccaccctcatctccccaacccttacccctctatagctccatcctggcagaatctgggtcttcccctgctgtcaaccccgggaagcccctggcctggatgtgacgccactgatttgcgcattgggggtcagagagaagcgagcttcttggtctgacaggcggcttgggattggaggagggaagtgggcccaggctctgtgaggaggcaaggtgagggctgagggagggatcaggatgcccccaccccagatagagggccccaaataatccagcttcgcccctgctgccagccctggaccatctaggggcaaacttctcagtcagggccaccccccagcaccctgccaaccctgccacttaagccgcaggggactctggagtcacagcaggtctgcttaagagagggcagggcccaggctctgccaggcatcaacgtcaggaccctaagttagggctgaaggccccccacccccattcccatcccccactccatccccatttccatctacactcctaaccccatcccccatgagaacccccatcctccccaggccccactactctcatcccaccccacccccaccctcatctaccctaccctcacccccctatccctacattctggtagaatccggtttcgcccctgctttcaaccgagggaatccccgggtgcccggatgtgacaccactgacttggcgttgggggtcaaagagaagcgaagttctcgctctgagtggcggcttgagattggtggagggaagtgggtccaggctctgtgaagaggcaaggtgagactctaagggaggactcaggaggcccccaccccagatagagggccccaaataatccagcactactcctgctgccagccctaaaccacctgggggcggacttctcagtctgggccactccctgcaccctgccagcccctgtggcttaagccgcaagggactctggagtcagagcttcgtgtgaccaaggcagggctggttaggagagggcagtggccaagctctgccaggcatcaacatcaggaccctaagtgagggctgagggcccccaacccccattcccatcccccaccccatccccatttccatccccatccccacctccatcccccaccagaacccctatcccccaccagaaaccctatcctgcccactccccaccacgttcatccctactcccaccattcccatcttccccacccctgaccctcctcctcaccctcccacccccccacaccctggcagaattcggttctgctcctgctttcaacccagggaatccctgggtgaccagatgtggtgccactgtcttgcacatttgaggtcggagagaagcaagggcctcgctctcaggggcagctggagatcagctgagggcagctggccctggctctgtgaggatgcaaggtgagatgctgagggaggactaaggagtatcccacccctggtagtggaccccaaataatccagtgccacctctcctgctgctagctctggaccatccagggcaggactccttaggctgggccacccccagtcccccaccgcttaagccgcaggggactcaggagacagagcttggtatgaccagggcaggactggttaggagaggacagctcccaggctctgccaggaaacaacgtcaggaacctaagggaaagctgaggctacccccacgccaaactctattcctgtccctacctccgtcccccacctacaccccccattcccccaccccatccctaccggcacctctatcccacatcccccacccctatcctggcagaatccgattctgcccctgatttcaacccagggaagccctagggggccggatgtgatgctgctgacttgtgcattgcgggtcagagagaatcaagggcatggttctgagaagccgactgagatcagcagaggggaatgggcccgggctctgtgaggaggcaaggtgagacccccgaggaaggaatgaggaagccctcacccagatagagaaccccaaataatccagtactacctttgctgccagccctggaccacccagggcagacttctcaggctggaccttcccccctccccactgccacttaagccacaagggactctggagtcagaccttggtgtgaccagggaagggccggtcaggagagggcaggggccaggctctgtcaggcatcaaaatcaggaccctgagagagaattgagggcccccaccccaacccctatacccatccctaaccccatacccactctacttgcattcccagccccatccccacaccctaccccatcttggcagaatctgtttctttccctgcagtcaacccacagaagccccaggaatgacagacaggcacacccattctgacgtccacatccagggctgaaggagggaaagggcttagtatcatgagcagggcctcaggggagtctctgctcctcaagccctgctgggagtaaagggaggcctcagggaacccaggtcctcaggatagggggtccactccaaccctgtctgagactgaggcgcctcctctttcatcctcgggaatcagagggatggagactcacgtcagcagagggtggggcccaaccctgccaggatcaaggagaggaagaagagggaggactcagggtacctttgagtccagaacaatggggacctttgccctgggaggtccagtgcacagtggccacctgtagcccatgcttgctgcaccttctgggtgacaaagaggagagggctgtggtcagagcagtggtgactcaggtcagcagagggaggagtcccagcatctgcaggccccaatgtgtgccccattcatgaagattggggataccttggctcagaaagaagggaccccacagagtctggctgtcccctgatttttgctcagaggggaccaaatcaaggatagccctatgtgccaacctcatttgtgccacaggaaagaagttgaagagccctcagggtgatggggtcttgcagtaaaggggagctatctgctcatctcagggggtttcaggttgaggaatggcaggccccatcacgatgaagagtaacccacaggaggccatagaaacactcaccccagaaccaaaggggtcatacctggacaccccatgtgggggtgacaggatgtagctccatctcattcctgttttcagatctcggggaggtgaggaacttgttctccgaggatgactcaggtcaacacaggggcccccatctggtggatagacagagtggtcccaggatctgtcagtagttccggtgaggaacatgagggacgattgagggcacccttgggccagaacacagatgaggacctcacggaaatctgccctgcccctgctgtcactccagagagcatgggcagggctgtctgctgcagtccccccgacttaccctgggatcattggtgtcagggatggggaggtctttgtcgaggggtctgcactcaggtcagtagagggagcgtcttaggccctgccaggagacaaggtaagaacgaagcaggttcctcacccaggacacatgaattccaatgcatttcagcatctcttcctgtccttcccaagaggacctgggcacgtgtggccagatgtgagtctcctcatgtcctgttccctatcagggatgtgagctcttaatctgagtttctcaggccagcaaaagggtgggatccaggccttgccaggagaaaggtgagggccctgtgtgagcacagaggggaccattcaccccaagagggtggagacctcacagattccagcctaccctcctgttagcactgggggcctgaggctgtgcttgcagtctgcaccctgagggcccatgcattcctcttccaggagctccaggaaacagacactgaggccttggtctgaggccgtgccctcaggtcacagagcagaggagatgcagacgtctagtgccagcagtgaacgtttgccttgaatgcacactaatggcccccatcgccccagaacatatgggactccagagcacctggcctcaccctctctactgtcagtcctgcagaatcagcctctgcttgcttgtgtaccctgaggtgccctctcactttttccttcaggttctcaggggacaggctgaccaggatcaccaggaagctccagaggatccccaggaggccctagaggagcaccaaaggagaagatctgtaagtaagcctttgttagagcctccaaggttcagtttttagctgaggcttctcacatgctccctctctctccaggccagtgggtctccattgcccagctcctgcccacactcctgcctgttgcggtgaccagagtcgtcatgtctcttgagcagaagagtcagcactgcaagcctgaggaaggccttgacacccaagaagaggccctgggcctggtgggtgtgcaggctgccactactgaggagcaggaggctgtgtcctcctcctctcctctggtcccaggcaccctgggggaggtgcctgctgctgggtcaccaggtcctctcaagagtcctcagggagcctccgccatccccactgccatcgatttcactctatggaggcaatccattaagggctccagcaaccaagaagaggaggggccaagcacctcccctgacccagagtctgtgttccgagcagcactcagtaagaaggtggctgacttgattcattttctgctcctcaagtattaagtcaaggagccggtcacaaaggcagaaatgctggagagagtcatcaaaaattacaagcgctgctttcctgtgatcttcggcaaagcctccgagtccttgcagctggtctttggcattgacgtgaaggaagcggaccccaccagcaacacctacacccttgtcacctgcctgggactcctatgatggcctggtggttgataataatcagatcatgcccaagacgggcctcctgataatcgtcttgggcatgattgcaatggagggcaaatgcgtccctgaggagaaaatctgggaggagctgagtgtgatgaaggtgtatgttgggagggagcacagtgtctgtggggagcccaggaagctgctcacccaagatttggtgcaggaaaactacctggagtaccggcaggtgcccagcagtgatcccatatgctatgagttactgtggggtccaagggcactcgctgcttgaaagtactggagcacgtggtcagggtcaatgcaagagttctcatttcctacccatccctgcatgaagcagctttgagagaggaggaagagggagtctgagcatgagctgcagccagggccactgcgaggggggctgggccagtgcaccttccagggctccgtccactagtttcccctgccttaatgtgacatgaggcccattcttctctctttgaagagagcagtcaacattcttagtagtgggtttctgttctattggatgactttgagatttgtctttgtttccttttggaattgttcaaatgttccttttaatgggtggttgaatgaacttcagcattcaaatttatgaatgacagtagtcacacatagtgctgtttatatagtttaggagtaagagtcttgttttttattcagattgggaaatccattccattttgtgaattgggacatagttacagcagtggaataagtattcatttagaaatgtgaatgagcagtaaaactgatgacataaagaaattaaaagatatttaattcttgccttatactcagtctactcggtaaaattttttttaaaaaatgtgcatacctggatttccttggcttctttgagaatgtaagacaaattaaatctgaataaatcattctccctgttcactggctcatttattctctatgcactgagcatttgctctgtggaaggccctgggttaatagtggagatgctaaggtaagccagactcacccctacccacagggtagtaaagtctaggagcagcagtcatataattaaggtggagaggtgccctctaagatgtagagaaaaagtaagaaaggggtgagggtgtggggctccaggtgagagtggtccagaggtaaatgccctgtgtggggccttttggactttgggaaactgcagtttcttcggagggagctgattctaatgaatcggcgggggggggggggggggtccagggccagattctcagagagtgtgagaaaagctcataatggaaaactgaacagttcttttttgatggtggatgaacagagaggagtggggcaggaatggaaagtatcttgtgctttagtcccagtgctgttgaacacagtgcaagagctaggtgatggacactcatcatctgaaagcatttcctgagagagaagcataaatctccctggaaaggagacccagaagccactggccaggtacttttctgcctgactgggagaactagagatgactctattaaaaatgaattttaattagattatctcaagtgcaatttgaccagttgtaagcaaagtggtgaaaacatgaatgaaaatagtgatttgcatggaaaagcatctgggagcgagggaaacagttagtctctgactcaaattcaaggagctttgagctgcatctggctgggaaaaactcccgcatactcaaattttgaagtacattttctaagaggtaaccacttactgaattttatggatgaaacttcattttttgtctaattattccatgtcctattgagctctatgttctctgataagtctcggagaagaatgacaacagcaaaatcccagagtcctagggcctggggtcaaataatgttagaaataacaggcatctgccactctttaaactcctaatttacaataggccctgagccaggtgcttcacctacgttgcacacactccaactgtcctactagacagggcttatcacatctgcttacagataaagaatcaaggctcacagggcttgtgaattgggacataataacagggtatttcttgggtatttcccaggatcacgtggctagtaaggaacagggctggaaccagacccctggtgtgaattcctttagagcccatgcagctcccactccccccagcccgaggttgacctcctgactgctacttcatttcgtttctcagcactgcaccatgtcgctcaggtgacaaaaagaaggaccttgagcacaacatactaaaagcagacctggaggtggcaatgagaatcaaacaccatttaggactggtgtatgctgggttcctcaagacctgactctgcccagatgtggccatttctgtccattcccagcactttccggaattaaagcacatttcccctggtcccttccatattttttgtctgactctggaacctggcctgctgaccagcttgtcattggtccccacagaacagcctagaatcacctgttctcctcctgacagggagcgtttcttctccctgtagaagtcctctggctgtcccatctctcacccaggaagccatgtgatagcaacaaccattttgatataaacattcacatgggacagtgacttttggacacctgggtaccactctggttatcttcgacacagtctccaagtgttttcctaagggattgagtagggtctgatttgccatattatctgttagttctcaggatatccccctgaagttacacgaagtttggaaccaccttgatacttgcaatcagacttttacagggtgtttgatttggaattcacctctgaacacatgcacagatgaatggtcaaaaaccaaagcttccctcatgagtattaggtgaggaaacactttggaaatcccagtggaacaaacatctacttactgaggctaaattcctaaatctctggagtcccccaggaggtgaaacctaattccttggaatacatgtcagctttgatgaaaaaggaataattaagcagccttctactgcctcttgtctgtttaattgctccatggaaaaatactggctttcagtgtgcctagaggcgcctgacaggtgttcagtcatgtgcagagtagcagaaactcacaggttatgatttctatcaagaatcaaatggaggaaaaaattctcagcctacttagtgggagctaaatgataagaacttacgaaaacaaagaaggaaacaacagactctgaggtctacttgagaggggagggtgagaggagggaatgaagcagaaaagataactattcggtgctgggcttaataccttgatgacaaaatctgtataacaaatctgtgtcacgtgtttacctatgtaataaaccttcacatgtaccctcaaacctaaaataaaagttaaaaaaataaagggtgttgcaaagataagccttcctgctgagaacttcaagattcttggacagttgtgatcctatattagaaagcatctgtgacatactagacccttgaacaaactggagaacttcaaggcaaatttggccttcttagaaattcctcctagaaatgagatggattgtgtaacaccaaattataatagttgctttttattgagcacttactatgtaacagtttatgggggaagctatattacttacccacatcttgtcttcctctcctgtctggacacatgggaacagtaaagtccacttgcagttaggaagagtagtgtgacaaccccttaccactgaaacatgagcagaagcattgtttgtcacatccaggaattgcgactgtgccattttccactttctccctcctttcaatggcaagcatggcagcttcatcttgagatgagatgatggaatcacaaagtggaagtagcatggatccctgggtcacatgagagtatagagcccctggcaaactgtatcaccaattatgtatgcataaaataaacttgtgtcatgccaatcaaatttcagcatttctctgatgcatcagctagcagttactgtaactaccatagctaccatttctgttaagcataaatattttgtatttcaaaggtaacagtttgcatattgttattgcaaaaattatagaagtgtatataattcacaattttcccctttacaaaactcctccacagtttatccccctccttagaggtcaccacaattaacaatctggtatgtattattttaaaactgactctaggctattaattgacagataagctataacaatatattgtttttatttaatacacaagaatgataatgtatatattgatctgccactagcctttgtcacttcataaaatggatatgggatctttccacaactgtgtatatatatatagatctctcttttgaaactaatttctataattctaaagtaggcatgcaccataattaattaaactctttcttcctaatggacaccagttgtttcccatctgctgtatgatgaatagaataaaatcatcttcgaatatgtattattgggcaaacattaatgttttcttataagaaatgtattaacatcgacgttgggtgaaaatgaaaagggtataaatagtttagcattttataaatatttctaaaatttcattgcaaaaatgctgtaccaattaacatttttaaaaaattaaaaatgatttgaaattctgatatgtggacaggagatttctcctctcctttcagaaagatttggtcagaatgaacaagagcctaggaaggagagagacaggagaccctcagcccgtgaggggcattgggaggatccaggggagagcaattgccagagtccatgagagagaccatatgcgaaaccaggaccacagagccccaggcaggctggcaatcagagctctgaatccagagttcagcctggtgggggcagggacctgagggaaagaagggggaagggagggggagaacaggacaatgaacaagaataggcttgggaaatccagggaccatcattaccaactggaaggggccacgtgatctgaatggacaggcttgttggctgaatgcaccagtggcgtgcaggacactgtaccctccctcagaatcaccttccctctgtcaggaagagtatggctggctccctgcatcattctgggtgagctacctctcttgaccactccaatgctcctctgcaaccttgccagtgtctcagggctgagtgctgtcttcatgcctactgggggctggtgttttatctcctgtggacccttcatagaggctgggctatgtgagtgggttgctgactgatgaccaacagccaagatgggccaggaacaccatggactccagtggcttctgagatcttggcacgcaagggggcggaagtcttggggctgtgatcgctggcctatgtttcaaccatacactgtctagggtagagggctggtccaatgtctggacatgggaaggttagatggaacccccgtggaaatggcactctccattgttaagctgacatggacttgcgtggtccaatgcaggaagtatcatgcactggtcctgttgggagcatcctcatctccatgtcagtgtttggccctggggaggaggtgtccacagtgacactctcagctgtagtttccatgagaactgtgacctcaagtgagcacaggtgagggaactatgtgtttcttcatggaggcaggaggcccaggtggggcagattccaagatttgaattagggaattcccatgcctggtaatttcattcattcattggttcatgcatgcattcattcatccggcaaacatttattgaacatatgctgaggacacactaactctacaaaacaaaaggaagtggctaggcccttaattcgttgtgtgaggggtgtaggggagatggtgaggtggaaagacatgtgagcattttaggaagtgagggactgggaactgatggagagaatctctattgatctgatttctagatgatgctgtgcccttagttgagagtgagagtggaggaggaaaagttggtgatgacttgatgaggaagagtgtggaggatgagatctgtgtgtattatgcagtcagagaggtgctgtagcctgtccatgtggagctgtcgcatgagcagtaggaaaatgggtctgtctatctggataggtgccagggctggacattaggtttggctgcatgagtagaagtattttgaggctataggttaaggtaaaatcaagtgattattgtgtagatactggcttacatgctacgtgacgtcattctgtctcttgaaaacacatttatttggtaatcaaaattactctaagcttaatgaaggaaggaagtgtacaggaggctggaaagggaggaagaacacttccagaaatccaaatagagagtgcttcctatatatgtgtgtatgcatttgcgtatatacatattcgtgtatatatacatatatacaaagatatatgtatatcttcatgtatacacgtatgtatatgtacaaatatatgtatatatttatgtatataaatgtacatttgtataaacatatacatatgtgtaaatacatttgcgtgaatacatatagttgcatatatatttgaggtggcttatgttgtatatagatttatatatcatattttcaatgtcgtatctgttacatcatgttacttttagtgctcttggcatctgtcgtccaagattaagtgtataattactaatacccagacacttatctcctctaacatagtgtgctgtttttggcagctggcctctctatagtaactaaataaagatgatcatgacaaccagagcaaggggaaagaagcaatcccaggtccaagtacctgggggtcagtacttcatgatgtattctgtatctggttggtggaaagtggttttcaaaattttagatgtgcaaacccttattccaatggaagccttccacaaaactccagtccatgaacatggggaagacagagcagtgtggatgaagtgaggactctaatcccatagtcttgtccacccagcaccttttcttccctcagagcattgggccaccctgacacccctgagcactactggggcagctctgtgcaaaatgcccttcctcagatatggactttctcatgccctacaacaggcatctctctgtgtggatgtcattctctctactgcacagaatctcaactttgttgccaggcactgccaaaaacttgtgaccttccaaactccattctctgtatatgctacaattccatttctgatttcccaagctcttcactgtctccccgcaccccatgcactgacctaaacacatatggaacacactatcctcctgctcacttgtgtattctttattctcagcatgggactcactcccctccctccaactcaccgttcccctttgggatttgcataggctcttcattcccgttgaccccaatccctgtcttcaccttcattcctagccctgcttcaaactctctaggaaaggggtccctagtactgcctttaccttgtcacctatcagcaccaaataacatgatgggcattttcactttttgtgaaagtattcttagatcacataaaagcaccctgaacaagagaggagagcctggtacatttttcttatgtatgttgcctctgctcccccagtacagcacacaatccccttgactgatattcagattgcctaatctcaactaaaatctattaaatatgtagagcttaattccctttaaggacaaagggtgaagtgatgcctacgagttccttatttaacagagaagggtaatttgggtgtggagttcacagcatcccctccagtgacattgcgttcacactttaaacgaagagcggcacttcaatgtctggcatatgtaggcccacctggctactgtgctagggccttgagtacaaacaggacgacagctggccagagccactggaactcagaagagtcaaacacgtgaaaaccaacagttgatttccatttctcccctcttagccttttgtctattattggcacacattttattcctacatatgttatatacttcatcatacagtatgattatttttactttaaatagtcaactatttcttaaagacatgtacataatatggagattatatttatccatgatgttgcaattcctgatgcaattcattcttttatttagatccagattatctggtatcatttttcagtctgcctggaagacttcctttaacatttgttttaaacatcctttaatgtttcttgtggttcctatctggtgattaattatgtaaggtttttcatttcagaaaagcctttatttcacctctgttttgctagatattttcacagtatatagatttctaggttaacagttttgtttatgtttcaccactttaaagaggttgctccacactcatcttggtttaattgtttttttatttctatttttgaatttaacattttttttttaagatttttcattatttttgtagagatggagtcctgttctgttgcctaggctggtcttggactcctggcctcaaatgatcttcctactttggcttcctaaaaggctgatataggaacgagccactgtgtccaattggtttcattgtttttgacaagaaatctactcttatccttatttttgttcctctgcagctaaactgtcttttttctcttgatactgttaagattttctctttatcattggtttcaagtaatttaaatttcatgaaccttggtatagttttttttccatattttttgttcttgaaatttgtttagctttttggatttgtgggtttagagttttcatcaaaattgaagctttttcatgcattattttatcaaaaattttttctgttccctcatttttctgtgctttagtctgcacatatctgtacattaggccacttgaaattgccccacaactcactaatgctctattcatttttttcatttatttttctctctctctgtttcattctggaaagttttactgctatatcttcaagttcatcaatcctttcttcttacatgtccaatctgccattaatccaaatcagtgtattttttttcaaatcatacattgtagcttccacatttcaaagtttatttaggtcttttttaatatcttctacactaatatgtttaaagttttctcttattttttggatatatggaatactcttttgatgttcttgtctactaactttatcatctgtctcttttctagttcaaatttaatttatttttctccttatttttatcctacttttctgtttctttcaagacctggcaatttggcattggatgtcagacactgtgaattttaccttgttgagtgctgggcatttttgtgtttctataaataaataatattcttgagctttgctgtgaaactcagctaaatttattggaaagagaaggattgttctgcatcttgcctttgaactttaagtgagataaaatcaatgtttagtctatggtcaatgttgcacttctaaagcaaaattattctgtatactctaaccaatgccccatgaattgtgagattttccattctgactaatgggagcaggaataattccaagacctgcataatctttatagatttatttctgtgaaactctttcctttctagaattttgtcctacaggtactatccatcttggcatgcctatactctcagctccatgttcttaactcaaagagacaatcaggatccccttctgtgcactgtgatctacaatgtctctttaggcggtaagcttgtgcaatcataggactcaactcacttgttttttatctcccagagaacactgtcttctttgcctaatgtccgataaattgaaaatccgtttcacatattttgcctggtttttagttgtttcagatgggtttataaattaggtccctgttcctccatcttggccagaatcaggagtcctatactacaaatttagaacctaaatgatctttgcttgacaaatgccctagcatatcaacttcctcaaataaaagccagattgaaagactatggaacacatgtacatatcaaagagacatacttacatacaactgggagtatatacagtaaactattaacaatggctttctgctgcttatggaaatataagtgtttttattctcttatttatgctttcaatatttctaacacctctgaagtgcatatgaattagcattataataaaatattgtaaatattttaaaatgtggtttagattaccaaaaataaacacatattctctagatggtttgtttgaaatattgatcggccttttgatgaattctactcagcctctggcatgcttgctgctcatgtaactgtagaaaaacaaaaagactttgaaatccaattagtaaactatgcgtagtcatccaacttatctcagactttcaaatacaattgctcacaggtaataatctatcttgtttttaaaatcttttctctagaaaacgtaataacttttatttttaaaaggaaaattatatttatatttaagccatattcccaatgacatgattgaatttaatatttataggaaggattgtatgcaggtaatagtggcagaaggaattgttgtaataactttcatttttatagtgttgtttatgtcttttgtcaaaagtttgttgtttatatgtctcttgtaacaacttacgataatgtttttaaaaatatgtctctcagtcattaatgtcagtaattcctagtcactattgaatatgtactttttaaagtactgacattcataaaaaggatgcaatattttcataacaataatctgtgttttctttaacgtctttgcaatacatcacttcttatgtttatatgtttatctttcacacacaaaagacattgcgtgaaaagaacggtaattcgccatttcgtaacaaaagctaaaattgacaaatgggatctaattaaaccaaagggcttctgcacagcaaaaaaaaaaaaaaaaaaaactatcatgagagtaaacagacgacctacagaatgggagaacagttttgcaatctatccacctgacaaaggtccactatacagagtctacaaggaacttaaacaaatttacaagaaaaaaaaacaaactaccccattaaaaagtgggcaaagtaggctgggtgcagtgactcacgcctgtaatcccagcactttgggaggccgaggcaggtggatcacgaggtcaggagatcgagaccatcccggctaacacagtgaaaccccgtctctactaaaaatacaaaaaaaaaaaaaaaaaaaaaattagccaggtgtggtggcgggcgcctgtagtcccagctactcgggaggccgaggcaggagaatgacgtgagcccgggaggcggagcttgcagtgagccaagataatgccaccgcactccagcctgggtgacagagcgagactccatctcaaaaaaaaaaagtgggcaaagtacatgaacagacatttctgaaaagaagatattcgtgtggccaacaaacgtttaaaaaagctcaccatcactgatcattagagaaacgcagatcaaaaccacactgagataccatctcacaccagtcagaattgctactattaaaaagtcaagaaacaacagatactggcgaggttgcagagaaaaaggaacacttttgcactgttggtgggagtgtaaattagttcaaccattgtagaagacagtaaggtgactccttgcaatcctattactgggtatatacccaatggaatataaatcattctattataaagacacacgcatacgtatgttcattgcagcactattcacaatagcaacgacatggaatcaacacaaatgcccatcaatgagaaactggataaagaaaatatggtacatatacaccatggaatattatgcaaccataaaaagaacgagatcatgtcctttgcaggcacatggatggagctggaagccgtcatcctcagcaagctaacgcagaaacagaaaaccaaacaccacatggtttcacttataagtgggagctgaacgataacatatggacacatgggggaacaacacacactgtggcctgttgggggaaggggagggagagtatcaggaagaatagccaatggatgctgggtttaatgcctaggcgatgggttgatctgtgcagcaaaccatcatggcacacatctacctatttaataaacctgcacatcctgcaaatgtaccccggaacttaaaataaatgtttaaaaaaaaaggttttttctcctgtattttattttcaaactgcttatagtttttcatttatcttttagatatattatctttgtataaaatatgaggtttagttagagattcattgtttaacatatggttgtctaattgttctaataaaattcaatgaaagaaccaacatttctcaattgaatttccttagttctttgtaaagactccatggactatatttgtgtggttctatttctgggttctctattcagttcccttgatctatatgtctaccccttacccaatatcacactctattgattactatagtcttagtgttaattttaaagttgggtagtatgaggccgggcgcggtggctcacgcctgtaatctcaacactgtgggaagctcaggcgggcggatcacctgaggtgatccagcctggccaacatggggaaaacccacctctactaaaaatacaaaagttagcttggcatggtgtcgggagcctgtaatcccaactatttcagaggctgggacacaagaatcgcttgaacctgggaggcagaagttgcggtgagcccagatcaggccactgcactccagcctaggcaacagagcggctccatcaaaaaaaaaaaaaaaaaaaaaaggaataaagaaaaaaagggtagtatgattcttccagctttattctgcctttccagaattatgttaatgattctagttctttagccctcctgcaaaatgttgtcagggtagagggttgtctttttttttttttttttaagaccgagtctccctctgttgcccaggctagggtgcagtggcacactctcggctcactgcaatctcagctcctgggttcaagcgattctcctgcctctgccaccctagtagctgggattacaggcatgtgccaccttgcctggttaatttttgtatttttaatagagacagggtttcaccatgttggccaggcttgtctcaaactcctggcctcaagtgatcagccgcctgggcatcacaaagtgctggaattacaggtgtgagccatggcgccgggcctacattttttgatcagtttgtctatatatacaaaaattcctgctggaattttatttggcattgctttgaacctacatgtcaatttggtgagaattgattgacctctttaccatgttgaatctttaagtccacgaacaaagtgtccctatctatttatttaggtgctctatgatttctttcattggcattttgtagttttgtagttttcagcatatagaccatatacaatatttagatttatatataaatatttcttttttcagtgtcagtgaaatggtattataaatttggtttctacatttcattatatggatatatgactcatttgtgttcattgaccttgtgtcctgccactttgttatactcatttattagttgtagaatttttttggcattttcttgggattttatacatagacaattatgcccctgagaatggaggtgatgttatatattttattccagtctccttgctgtatttattcgtatatattcttttgctttattcagtattttattataaagttggacattagctgtagtgtttttgcatatgccctttatgaggttaagttcttatttaatttatttctcattttctgagggttttttcacaaacggaagctgcatattgtcaaagagagttttttttccttcaactgatatggtcaccacactaacagacaaattagtctgttagtgtggtggcttacattgtggttcgctttgtttcagttgtgaagtgtcgaattagcattgcattccttaaataaaccttgcttggtcatggtgcattatccttttttatagatttcttagattgcatttgctggtatttgggtggaggggattatgtcatcattatatgttctcaaaatgtattggtctatagttttcctttttgtgtactgtcctgccttgttttcatacaagggtaatcttaacctcgtaaaatgagttgggatatattctttcctcttctattttctggaatagattttgtagaattggtgttaattccatttaaacatttgggagagatcaccagggaaaccatctgaatcataggtttctttttcaaataaatttaaactatggcatcaatttcctcattagttttacttcttttgatatttttcgttttctctagggtgaattttggtagtgtttgatttttgggggaattattcaatttcatctaagttcttgaatttaagtaaataaatttgattttattatttccttttatccttctattttcacaatatgtgtaatgatatctcccgtttaattcctgatactggtaatctgtgtcttcttctttttttctttttactttgtctgtctagagctttctgaattttattgtttctttcaaatagccagcttttgggttccttgattttctctatttattttcacatttcatttcattcgtttctgctgttaccttttttttctgttttttttttcttaattaagatgaaaagcttagactattgcattgagagctgtattatttcttatctaagcattaaacgctctaattttcccttgaaacactgctgcagttgcatcctccaagttctaatatgttgcatttgcaatttcattgagttcagtgcattttttatttccttgagacgttctcttagacccgctgtttaggtcattgatttaagaggcttgtttaaaagagtgctgtttaacaaccaaatgtctagacattttccttttgttttgttattgttttatttctagtttgattacagtaggtttagagactatactctgcatggtttgaatttttgataatttcttgatgttcgttttaggacctagaatatatgttggtgaatgttccatatgtacttgaaaagtatatgtattttgctgctgttcggtgcaatgatatttggatctacagtgtttgtaaaccacccaaggccctgtgactgaaacctggacagtgatctaccaatagaacagttttccaagcctttgttatcttatttatggtaagatttttgcgtgagcacgtcaggttgagcccagtacttgatacacaacctgagaggatccctttctcacatttcctcttctccatgatctctaccacactttctgccacccaggggaccctccttctggccttttagctagaaaaggggctagtcactctgatttccccttgccttgaatggatctgccttgatgaccaagtgacaggagaatatagagagaaaaatacgaaggaggactcctctcattcatagaccaatgttcttttgtcagagagaagggatttccttcctcagaggtttaggtgccttcacaacttttgccgatgctgtcaccattaagttacagcttcaggactggagcttgcctgagtacacagctagcaaaataataatggcatttggacaactctctgtgtcctgtagaggccctgtattctattccttggactaaaaatagaggcattttcttggcactctttctgtccacaacttgcgtgcaattattgaatttgtgctgcatttgagtccaggctgggagatacaggaggcaaaaatagcacaagaaattcatcaccatattgatttttttttttttttttgagacagagtcttgctttgttacccaggctggagtgcagtgatatgaccacagctcactgcagcctagacttcctgggctcaaaggattctactacctcagcctcccgaatagctgggactaaagtcaggcaccatcatgcatatataaatacataatcgagatgagattttgccactttgcccagactggtctcaaactcctgggctctagcgatctgaccacctccacctcccaaaagtgctaggattacagacatgagccaccgcacctggccacattgatcttactttgagttctgattcccttcctcaatcttcctgcttccatttaattttttcaataaacgttttatttgtcagctttttatatttacagaaaagttgtgaagagagtcaatagagttcctatatatttcacacgttttccttattattaatattttatattgtgatgatacatttatcacaaatagcaaaccgattttatcttagtttttacctaattttttttttctgtttcaagatcccatacaggacatcacattacatttagttgtcacgtctctgtagtatcctcctttggttgcgacagtttctgcaaattttcctctttttaaaaattaccttacagttttgaggagtactagtcagatattttttatactgtccctcaattaggatttgtctgatgtttttaccatgattggactagagttatgagttttgggtagaatgactggagaggcgaaatgcccttctcatcacattatttcaaggctacatggtatcagtatggcttatcactggtgaagttaacactgatcccctggtaaatggagtataataaacaatggaaatacgtatcacaagaaaaagaagagcaccagatataaaattctaaattgatattctccccttctttaacaattgaagtatatgacttttgtcttaggcataatttttaaaaaatttttgtgggtatatattcatgaagtacatgaaatattttgataaaggtacacaatgcataataagcacatcaaggtaaatgggatatccatcacctcaagcatttatccttttaacgaacaatccaattatactcctttagttattttacaatgtacaattaaattattattgactatactcaccctgttgtgctatcaaatactagatatttttcattctttctattatttttgtgccaattaaccatccctacttccccccaaacccctatctttcctagactctggtaaccatctttctattctctatctgcatgagttcaattgttttaatttttagctcccacaaataataagaacatgcaaagtttgtcataatgacctccagtgccatccatgttgttgcaaatgacaggatctcattctttttatggctgaatagtactccattgtgtttatgtaccacatatcttttatccattcatctgttgatggataattaggttgattacaaatcttggatattgtgaacagtgctgcatgaaagtgcagatatctctttgatatactgatttcctttcttttgggtatatacctggcagtgggattgctacatcctatggtagttctatttttagttttttgaagaacctccaagctattctccatagtggttgtactaaattacattccaccaatagtgtatgagggttcccttctctccacatcattgccagcatttgttattgcctgtgttttcgatataagccattttacctgggatgagatgatatctaattgtagttttgatttgcatttccctgatgatcaataacgttgagcacctttcaatacatctgtttgccttttgtatgtcctcttttgagaaatatctattcagatattttgccactttaaaatcagattattagatgttttcgtatgggattgttgcaactccttatatattctggttattaatcccttgtcaggtgtgtagtttgcaaatattttcctcccattctgtgggtttctgtgggctgtctcttcacattgtggactttcctttgctgtgcagaagtgttttaactttctgtggtcacatttgtccatttttactttagttgtctgtgcttgtggagaattactcaagaaatctttgccaagtcctacgtcctggcgagaaaacaacaatgttttcttttagttgtttcatagtctggagacttaaatttaagtctttaatccatttttatttaattttgtatatggcaagagataggggtctagtttcattcttctgcatgtggatatccagttttcccaggaccatttattgaagagactgtcctttccccaatgtatgctgctggcatcttggtagcctttgttgaaaatgagttcactgtagatgtatgggtttgtttctggtttctttattctgttccattggtctgtgtgtctgtttttatatgagtaacgtggtattttgtttactatagctatgtagtataatttcatgtcaggtaatgtgatttctccagttttgttcactttgcttaggataggtttggctattctgggtctttcgtggttccatgtaaatttttcagttattttttctatttcggtgaagaatgccattggtattttgatagagattgcagtgaatctgtggattgctttgggtagtatggacagtttaagcattttttccttctaatccatgagcatcaaatacatttccatttttttgtgtcctcttcaatttcctgcataaatgttttatggctttcattgtagagacatttcacttctttggttaattgttatgtatttaattttatttgtagctattgtaaatgggttactttttatttctttttaccgttgacgtatagaaatgctacttgtttttgtatgttgattttgtgtcctgcaactttactgaattcatcagttttaatagttttttgcggagtctttcagtttttccaaatataaaattatatcatcagcaaacaaggataatttgacttatttctttccagtttggatgccctttatttttgttctcttgtctgattgctctagctaagacttccagtactatgttgaaagtggacattcttgtcatgctccagatcttagaggaagggcttccagttgttccccattcagtatgatagtttttgctgaatttttttaaaaagccaagctaaataggttacatattgtatgagaatctgctgtaattcttatctttgtttctctgtatgtatttttttcttcttattgtcctggagattttatatttatctgatttttttcagttggagtactagctatcttttttctcctatttagtgttccttgagctaagtggatctttggatttttgtctttcattaattttggaaaattgttggccatcatcttttcaaatgtatctttgacccttgaactcttttctctcttctcctataactccaatgatgtgtactctagacaattagttattgtcctatcattcttgaatgccctattgcgttttattcacttcttttctttttgtgttttattttgaataatttctgttgacatctccagtttattctgtctttcttctatggtgtttattctgtcaatgagcctattgatagatactgggtttaattctggaatttcaatttcattctttcttatagtttacatttttttcttaggaagttgccaatctcttcacgtataatattaaactttcccaatagattctttaacatattaattgtcgttattttaaagtttctttcttatataaccaacatctgggtcatctttgagtccagttctgttcgttgctttttgtcgtaggaatggtttgattttcttgactttttatggttttgtaatttttaaattaatgccagacatcatttgtagaagaacagtacaggtgagtaggtaactagcatttatgtctagaaattgacatctgcttcttctgctggatatcagtgtgttagtcaatttagttggtacggtaggttacttagatttcgattttgttgttgttaccagctccaaaatcttccactatcaaactgttatttgtgtgtactgtgaagagggtgacactgtagagttttcctcagtgtttctgctcctttctcagcttttagcaatcttaatacaatggtgtcacgatggggctctcaatctgcattctcccccccacacccccactccctagtggtagactactgctgccctttatttcatgttgaccttgtggtcgcagcagctggggtccttggttcttttcgtgcagcctcagtcttattcagaacctgtatgtctagttttctgaggtgaggtctccttagcatttctttgtctccctctcttggcagtcaaactttgccctgtatctttggaaggtctcaaacagaagaaagtacttgcccttgccccatttacactgataacagaactctgctttgtattgatgcgggatacagccccaaaggtttgtctgcccctcccccatgggcagatggcttttgctttcacccttccctcagaagctacagacctttcatcgtgtttgaaggtagaaaaaaaaggttttctaccacccaccccacccacccccaggcacacagattttgcttttggccctccgctagagttcctaggattgagatggtttgctgctccttcatgaatggcctctctcaatctcctgctgttgggccagttattcttacttgtgcccagtggaagtaaagaagagactttaagtgagtaagaacttttctatatcggggactccaagttagtctaaaccgagatgataagccacacttgggctttagaaattcattaaaagtttagctgatttcttattacttgcttctatgatgcctattactcctgttttctgccaaaatttagtttgtgtgtcctgtctctccttggagggatcgtcatcctttggaatttaattcccttgactgccttgcaaacccagctttctgaatggttcaataaaagttctgatttgatagaatatatggaggcttcttattgttaggatgggcgtgatgttctcttgcaactttctacctcttcaaagaaagcagtgcctagggtaacctagattttgacctttatatacatgaaatcataatgtatgcactctttttttgttctagctactttttttcaacattatatttgtgagatttgttcatgttattaatgtaattccagtttttagatttttcattggtgtactgaagctcattttatgactatatcacaaataatttatctctcctactgtttatagacatgtagcttatttcaaatgtggagttattctagataatgctactatgagcatttttgtacacgtattttggtaaacatatgaaaaaataactcttaggtatatgcctaggatagcaattgatggttttatatacagagatatgtaaaatatgtgtatatatacatacatatacatatatatttcagatgtagtagatgatgtcacatcattttccaaagtggttataataatttctattttataagccgcatacatagaagagtccttactcacctgaagtctcttcttctttgacttccactgtgcacaaataagaatgactggctgaatggcaggggtctcagagagccccttcataaaggagcatcaagcagtctttataacttataagaatttattttgctttacatgtttgctaattttcgttgacaattttaatgtaaatttcttattgacagataatatacatatagagaagggcacaaattgtaagtatatgattttatgcatttttataaagtaaaaccaaccctttaactaccacccaaatttagattagaacattatcagtactccagaattcttccctatatttcatcagtcattaacccccagcaataaccactattctgacttctatcatcataaattagttatgcttaccttttgtttaaaaatcaactttattaaggaataaattacatacaataaaatccactcttttatatatacagtttaatgagttttgacaaatgtatatacctctgtatccactaccataatcaaagtatagaacatttgtattactccaaaacatttccttatgtttctcggcaatctttccccacctcaggatccaggcaactacttatctgctgtctgttactatagattagttttcccttgtctagaatttctttattgttattttttttattttattttttgagacagggtatcactctgtcacctaggttggagtgcagtggcccgatcatggctcactgcagcctcaacctccgaaggctccagtgatcctcttgcttcagcccctctgcgagtagctgggattacagatgcatgccaccacacacagctaatttttgtatttttagtagagatggggtttctccatgttgcccaggctggtctctaactcctgggctcaaacggtccacctacctcagcctcccaaagtactgggattactgagccactgcacccagccttgtctggaatttcatacaaatggaatcataccatttatactgctttgtatgcagctttttttggtatcacaattattatttggcaatattgttgcatatatcagtattttgttcctttgtgttgcctagtaatattttagttttgcttatttttcacttatataagtggaatcatacagtatatattcttttgtgtggggtttctttctttaattcaaagatatttgtgagattcattcatgttggtgatttcacatttgttcattctcattgctgcatagtatttcaatgtatgaataattcaccattttaaaatccattttattagtgataaatatttagggtttttctactttgggactattatgaataattctcccatgaaaattcatgtacatattcaacagcaattgctgggatatattttgatcatttactcaaatatgagtaatgccctgttgttttcccaagaggtcatagcaatttacattcccaacagtggtgtgtattgagcattcctgtcattttacatccttatcaacagttaattaagacagctattcaattttatcagctgtagtgggcatgttgtagtatttcacagtggtttaaacttgcactcctgcatttataggcaaataggttgatcaccattttatatgcttgttggctatttgtatatcttcttttgtgaagtgtctgtttcagtctctcacacatttttacatcattctgtcactttattattgacttgcagaagttatttatacactgtagatgtataaataacctggtttattttatgtgttgcaaatgtcttctacaagtgtggcttgtcttttcgttgttttaatgctttttaaataataaccaaagctcttaattttaatgtagtccaatttatcggtcttttcatttactattagtgctttgtggttagttttgctttatcattatctactctagagcaacaaaaatattcatgtatattaccttctagaagttttattgattttcttttctcattaagacttatgatccatattggaaatgattactatgtagcttttgaggtataattctctttttacataaatgttttcatttgccccagtaagttttgttgaacgaatcatccgttcactactgctcagcaatactacctttgtcttaaagccttaaagcatatattcacatatatatgggtctgtttctgtgatctccattgggttccattggtttattttacttgaaacaacaccatgccttcttaatttgtaattgtatgataaattttgaggtgactttggctttgtcaatgagttattaaattcagtaacaataccaagatccatgaaaaaagttgatgatactggacttgattaaaattaaaatattctactctctgaaatacactgttaagagaatgaaaatacaagccacagaccagaagaaaatattttcaaagcacatatatgacaaagaacttgtatctaaaatattaaaaagaatatttaaaccttagatataagaaaacatacaacctaatcaaaaacagacaaaatattcagacgcttcaccaaagaagacatacagatgtgaaataagcatatgaaaagatgttcaatgtcatttgtcattaaagtactacaaattacacaacaatgtgatacctctacaaacctattaaaatggttacaatccaggagttaacaatactaaatactgagaaaaatgcagagtaagaagaacttatttagtgtttatgagaatgtaaaatgccacaaccactttggaagacaatttgactattccttcaaaagttaacatagccttgcaaagctaactatatatgaatcagcaataatgttcctaaatatttatccaacatatttgaaaacttatgttcacacaacaaatgcatatgaatgtatacaacagctttattcgtaataaccagaaaatggaaacaaccaagatgcttttcaatagatgaataaataaataaaccatagtatatccatacatttaaatctatttatttttattgtaaatagaaattagctattaagttatgaaaagaccgagatgtaccttaaatatgtatagttaagtaaaagaagccagtatgaaaaggtgaaaaaatgtataatctcaattgcatgaaattctggaaaaggtacaactatggagataacaaaaatatcagtggttgccaggggtttggaggatggaatgagagttgagtagctgaaacacaggggaattttagggtggtcaaaatatgctgtattatactttaatggtagatttatgacattatacattttttaaagcccatagaactttacagcacaaaatataaacctccatttacacaaatttttaaaaagtcatttaggctatcaggtgattcccaagaaggaatgcatactatgacaataaaatccaactgtattctaagtgtatgaaataatcttagtgaagaggttgggggaaaaggtgctgaccaaagtaactctggaaatgacagcagactgtaaaattaaaggcaaaatgaactgcacataagcacagtactctagttggtaaagttatttcccttggaggtacagattagcaattctgatgctgctatacatgtatgctgaaattggacagctaagtaaatgaatggtagatgggagagccatatttttcactgattgaatgggaggttatagaaaagcaagaggagtttaccttaattcttgtggcaatgatttagagttgaatacattagtttgaaatcatgctcacgttaatatggatacagatttttcatgtattaaatatttatagacatgtgtacatatacaggttagtaaacacacatatctccttgttctgtcagctgagagggcctagaaacaacaaattcccaggagcaaagagcacttctagcagtcagatttaggtttctaaaaccattttccagtaaattaaccaagtgtctttggagaaatgattctaggactgaggcaaggagtatacaaaatgagccaaagcatcttttagtgccagaaagttataaagtaatttaaaaaccctacattgatggaggtgtgtcaaagggaccaaggagccagcagaaagaactcccaatggccaaagctgaatcaatttgaacagcagaataaagtagtattggattataacctcaagtataaaataaatttccatgagttcttatcgatataaataaatgatttaataaataaatggggtaaagagacaattaccccttgtagaagaattataaggaagggaatataaattcccatttcttaagtgtggagtagaggaatagaagtcaccatgcatagctatttcctttcaaagagtgcagtataaaagagagggaaaaaatagcttcatggtggagaaacttgacaaacactatctcagccaagtgataaaagtcaacatcggcgataagtcatattgatagtatatacccctgatattataaaaattgaactttatttttgtggttttctgccaaaagcacaaaaccccaatctaactacgagaaagacacccaacaaatctcagtagataggcattacacaaagtacctaaccagtagtcctaaatattgtcaaggtcataaaatacaaagaaagtctgagaaactatcacagccaataatatcctacagagatatgacagcaaatatagtgtgttattctagatgggataccaaaacaacaacaacaaaaaggacattagggaaagactaaggaaatctgaatagattatagactttagttaataataatgtatcaatactgtaacaaatgtaccatacccatgtaaattaataataagggaaattgggttagggagtatctgggaactctctttactatgtttgcaatatttctgtgaatctaaaaatgttgtaaatctaaagtctgttcaccaaaaaaaaaaaaaaaaaaaataagctgaccaaagaagtcaaaatctcctccatgattaaaattctctcaatgtttcccttcccctctgcttccaggatgtaaccttcaagcccctgagcctcttagtctagtcttgggagaaaattctacatggatgattgtgtttctgcacattttggaaggtaactaactaactgccctcctgttcccgactgtcttttcaaggctatttgtatagtgaacagccttggaagatagagatggtttttctccagaggaaagggaaggtttacttattctccagtccaataaagataatgtctttacctaatttattgagagtttttagcatgaaggttgttgaattttgtcaaaggccttttctgtatctattgagataatcatgtggttgtcattggttctgtttatatgctggattatgtttattgatttgcgtatgttgaaccagccttgcacagaatgggagaaaatctttgcaatctactcatctgacaaagggctaatatccagaatctacaatgaactcaaacaaatttacaagaaaaaaacaaacaaccccatcaaaattgggtgaaggatatgaacagacacttctcaaaagaagacatttatgcagccaaaaacatgaaaaaatgcttatcatcactggccatcagagaaacgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaaggcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccatcaatgatagactggattaagaaaatgtggcacatatacaccatggaatactacgcatccataaaaaatgatgagttcatgtcctttgtagggacatggatgaagctggaaaccatcattctcagcaaactatcgcaaagacaaaaaactaaacaccacatgttctcactcataggtgggaattgaacaatgagaacacatggacacaggaaggggaacatcacacaccggggcctgttgtggggtggggggaggggggagggatagcattaggagatatacctaatgtaaatgacgagttaatgggtgcagcacaccaacatggcacatgtatacatatgtaacaaacctgcatgttgtgcacatgtaccctaaagcttaaagtataataaaaataataataataataataataataataataagataatgtcttcctctaggacagggtcagggaggtttgcttacagtccattataaaagattaagattacataactttaatgtccctcagctgtgacaataaccccatacatgcatgatatgtacctgaatcatgacatgtcacatgggacaagcaggggagggatgaggtaaacttacaaaactttgaagttcatgcttcttgttgtatcctcagtaataacttcctttttctgtgacacagactcatctgtgagactatggcagacaaacttgttaactagtgagtagggtaaaataccagacactgcacagttcctgacagtatggtcttggtggtcaaggccctgccttacctccagctaaacattctgtcatttcttctttgataacctttgctccagctacatttacttgtatatcttcgaatgacctgtggaagttcagccaagagtgctcttttctattaatctatccatgtccttcttcctgttttatagaccttcctgctgtccacttacccccagatgagttccaatgcagtagctgttcttctagagaagacagctcagagtccacttctatccctggttgttctgtgccgtacttgttggtctcctcctgtgtctctccatctagtttatgaagccgtgaaaaaggactcatcttccttcacagggcctacaatagtccctagcatgtagtaagcacacacacaaaatatttgctgaacaggtgaaagaatagtgaagctttttcacataacttatctcatagcttgacgctatgagtcacgcatgtgactggtgatatttaccaaaaacctagcagtcctgcaagctcagtaaatgccccaattcctactcaggccccctaaattctgggagttttaggttcttaattcctttgactttagcctcgtaatgttctgataatataattcctgcgattcctcttgcttcagaagatagctactcatgtcacatatgttaaattttattgtgtgtcttgggtatcataggggaggtatattttccacagtggacaattttccgccttctctttttctctctcttctttaacagaaacaaataaaccccaccaccccaatgaatttttaaatatgttctatttacctgtgcatttttaaatttatcattttattaatgtttctttattgcccgcaattttcccttttttgccagtctgttgggaaaccttaatatatgtgagaactttgtatctgatgggatggctctcattcaacctcatccctcaaagcagtcttcttagcctggtggctggtattcatggagtgaattcacaacttcccctctttctgtctcaacttcatttaacctgtcaaatctaaatttccattgtctttttttccactttcctttattgacatataacctacctgaaaacttgcatacctgttgctcaataaattattacagagttaatacaccaatgtaacaaccccttagattaagaaacaatatttccacaaacccagaattccctcacgctcctttacaattagtacttccttcttccatccgcaaagaaaatgctattatgtcatataatactactgattgcttttttcctgttttgtgattatatatatatattatatatataatatatattatatataatatatactatgtattatatatatattatatatattatatatataatatatattatatatacacacatataatataatatatatgtcaaactatacaggatgtcttatttatatttggcttttcttactaaagtttatgttttgagatccatctatgttgttacatatagctgtagatcattcatttaattgttgcaccgtattccatcttactaatacgccccagcttaacttatccaatctgttcttgatggatatgggggatgttttcagtctttgactttaatgaataatgctgccatgaacatttgtgtacaagtcttttagtgcacatgtgcatggatggatgttaaatataaacctcagaatgacgttgctgttcctaggatatgcatatttttaactggagaaattactgccaaacaatttttctaaagtgcttgaatcaacttgtactctcgccagcagttcgtaagagtcctcttagctgtacatatatttgttgtctgtatttttatttttaaccactctggtgggtgtgaagtggtatatcattgtgttttaatttgcatttccctgatgactaacaaggttgagcaccttttcatttgcatgttggccattttgatatccttctttggatagtgcttgtttgcattctcttgttcatttttctcttgtgttttctggcttttttcattaataatttttgcattatttatatattctggataagaagaatagtcagctattaattgctgtgtaacaaatcacctcaaatgtaaacgcataaaacaaaagccaatttattatggccactgattttgtgggtcagaaatttagataggacacagtgaggatgactatctccaacacccagtatccagtccctccactgggaacacttgagtggctgctggaatcatctgaggcttcttcactcacatgtctgtcatgaggcatgggatgtctaaaggtttggctccacttgatctgttatccagagcacttacacatggcctttttatgtggtttggacattctcacaacagagagacttcaggattgttggatttcttatctgctgtccttggacatcaaaagtgagtattgcagccacacaaggcagaagcttgcattttctcctatgacctagtcttagcagtaccatagcatcacctccactttctactgatcaaagcaatatcaagcctgctcagattcgtggggaggagagttagctcctattgatgggaagagtgtcaaaggatttgctaccacatttcaaaaccaccataattcaccctctggccacacattatttatattcctcccataagcaaaacacactctacctctcccaagaaccctcagcctcaccccacccaaagtccctctgtgccatggcatcaggtccagtatcttgtcatctaaactagctctagatgtgaataagactctccgagttcaatttcctgagtatgattcttcttgatctgaaggcctgtgaactaaagtgacaagttatctatcccatgtgatacaatggtaggacaggcataggatatctacaatagacactcctgttcaggaaaagggaaagtgggaggcatataagttttactgctccatagcaattctcaagccagttgggcatgcgttgacacatcttttgttatggacaagtcctcctccctagttgtgattttccctgtctcttggctctgccatccttattttttattctgtattcaaaatatttattttccataaaaaagtagcctgtgtttgcagctcgatagttttttcaggctgtttcctgactgtagaatttggggtgggtccaaagatctcctttggttttacattctctctccccctttcagtgcatgctggtataattactttaaaagcgttgtggagttttatgggtcagtgtataatcagctcctttagacaaatgccaaacccttaggtctcttcaagagataagtccctccttaacttgggcttcttgtgtggcagtcatggcatgattatgtcccccaaattctgaaaaatcctactgttcaagaaacatttatattgtataaatgttttaagattctaagaaagcattttttttctgcgagatctatgaatctctaccttaaattttctgatgtctttagaaagggttttatagtcctacatgggagggttttcttgttttttttttttgttgttttttttttttttttaggctcaatttttatttcagattcagggagtacaggtgcaggtttgctacatgagtatattgtgtgaagctgaggtttggggtacgatcgaactcgtcactcaggtaatgagcataatatctaataggtagttttctaaccttcgacctgccccctcccttccccttcttgtagtccccagtgtctattgttcccatctttatgtccctgtgtaccttatgtttagcacccacttataagtgagaacaggtggtatttggttttctgtttctgcgttaattctcttaagataatggcctccaactatatccctgttgctgcaaaggacatgatttcattcttttttatggctgtgtagtgttccatggtgtatatgtaccacattttctttatccaatccactgttgatgggcacctaggttgattccatgactttgttattgtgaatagtgttgtgatgaatatatgagtacatgtgtctttttggtacaatgatttgttttcctttgggtatatacccagaaatgggattgctgggttgaatggtagttcttttttaagttctttgagacatctccaaactgctttctacagtggctggacaaatttcagatgcatagtttgcaaatatcttcttccattctgtaggttgtctgtttactctgttaatagtttcttttgctgtgcagaagctttttagttaaactaggtcccacttgtgaatttttgcttttgatgtaattgcttttgaggattttgtcataaatcctttgccaaggccaatgtccagaagagtatttcctaggttttgttttaggattcttatagtttgagttcttacataaagataatgtaagtctctgatccatcttgagttaatttttgtgtctgataataggtaggggtctagtttcattcttcatccttcattagccagttataccagcaccatttattgaatagggagttctttctccattgcttatttttgtcaactttgctgaagataagtttggtttaggtgtgtgcctgtatttctgggttctctatttgattccactcatctatacacctgttttggtactggtgccatgtgttttgattactgtagccttataatatggtttgaagtcaggaaatgtgatgcttccggctttgtttgttgttgcattggcaattttggctcctttctggttccatatgaattttagagtagttttctaattccgtgaaaaatgacattggtagtttgataagaaaagcattgaatctgtagatttggcttcatctttatcctgagactgttttcctgacaagactctggattactatgagaacctattgttacctagaaagattttcctggaccttgttatatttcctccatattcatctttcaaaatgcacagttgttattacctccttagcccaggcacaaattgaaatgctaagttgctgtaaattactggccatgtttatggacttagcacaaaatatgcccccttataatatctttgctgcttggtaagttgggatgaaatgaacaccaacagtgtatggatctgctactaaacagtgggacaggggcacacaagggaacggaaatttagctaacccagcctacaaaaatcgcatgatataaacatcgtacctttccccaatccctttcccaaattgcatctcataccttagattttgacccttcaaatatgggaggtgtcagctggcactgtgctttaaagacagagaacatttgtttgtcatcctctgagtgcccccatatccagcacaggcttaaaaaagtctagaggctggactctttcaccaactgtcccccttttagggaatctataataaagagcatgaaggtgactcaacaatatctggtgggaaattctgaatagcttcactatggcagcaacctgtgtattgcgtttacattctcttaatggtttcttttgatggacagaagcccggttattaatgtagttcagtttacaaatcttttactttttgcctataaaatcttctgctccaaagtcaaaaaggtatctcctatgcattcttctagtaggtttattgttttactattctcctttagaattacaatatacccgggatctttttttagttaggaatcaaattttatttttttccacatagatatttggtatagccatattcatacagaaaaaaaaattctatatgccagcattgtcagaaataaattctccaaatatgtatggatctgctttcagactttctatttctgttacatttgtctattttcctgtccttgtgccttgtgtctgatttactatagatcatataacttgttttaataaatcagtttactgatgtataagttatatccaatagggtttacctattttaagtatataatttgatgagttttgacaaacatatatagttttctcaatccctgtgattaagatacatcaccaaacccatgttctcctagtctcctatgatatcttctagacgttttataattttgtattttacatttaggtctatgatccatttggagttagcttttgtgaaacatgtaagatctgtgtctagattcatggtgtttttttgcacatagatgaccagttgttccagcatcatttgttgaaaaggtcattatttcttccattgaattgcctttcttcctttgtcaaagatcaattaactacatttgtgtgggtctatttctgagctattttgttctattaacctatttatttattctttcactaataccacactgctgtgactaatgtagctttacagtaatacttgaagtcagatagtatcagtcctctgaatttcttcttctccagtgttgagttgactatcctggttattttgcttttccatttacactttagaatcagtttgtccctatatagaaaatgacttgctgagatttgaactgagattgcattgactctatatcaagttggggagagctgacattataactacattgagtctttctatcaataaactggacattttctcaatatatttagatcttctttgatttcttttttgagttttatagttttccttctatagatcttttatgtattttcttagatttgtgcctaagtatttaatattttggttgaaatttaaatagtgttgtgttttgaatttcaaattctaattgctcattgctagtatatagaaaataaattgactttagtacatattctgcaaccttgcaataatcacttattactttcaaaggcttttttgttgattctttgagattttctacatgcaccattctgtcattcatgaacagttttatttattccttcccaatctttatatccttttttttttattttcttgctttactgaattacctaggacttccagtctcatgttgaataagtgtggcaagagggggcattcttgcctttttcttaattgttgacagaaggcttcttatttctctctattaagtatgatgtcaattgctaaaaataatagatttttaacagtatacatggaatatttatcaatatagataatattctggataataccacatgtatcaataaatttaatagaatccatatcatacaaagtatggtctctgaccaaaatggaattaaactagaaataataacagaaatatatttgaaaaattgccaagaatttagaaactaaaagcacactgttaaataactaatgagtcatagaagaaatgaaaagggaaattagaaactttttaacaaaatgaaagcatgatacatcaaaatttatgggatgcagttaaagcagcgctaggagagaaacttgtaacagtaaatgcctacagtacaaaaatagtctcaaattaatgccttaaggtttcacctttaaaaatagagaaacacaaatagtaataatgataaaatggagaaataatacatataagagcacaaatcaataaaatagaagcaaataaacagcagagaaattctatgaagaaaaagctgtttctttgagattaataaaatcaataaacctcttcacatgccgatcagaaacaaaagagagatgacaaaaattattaacaccagaatgggaaaggaaattgactacagattctatatatattagaatatagaagaaaagaaacaaaatcaaatattatgaaacactttatgacaataaaattgacagcttacatgaaatggacaaatcctttgaagggcataaactatcaaaattcattcaagaaaaaataaataacttgaataactctatacctgttaaaatcattaaatttatagtgaaaaaccttcacacaaagaaaacttcaggcacagatggtgttatttgtgaatgttattaaacatttgttgaagaaataatagcaattccacacaaactcttaataaaaaaatgaagaggaaagaatacttcacatcacattttatgaggcttcccttcctcaaagtagttaaaaagacattacaagaaaagaaagctacagacatatatcccttaacatagatgaaacaattttgaacaatgttttaacaaattaactaacatataaaaacgataatatatcttaaccaaactgattttatattgagaatgcaagttggatttaacatttgaaaaatcagtcaacttataattctctatattaacaaactaaaagataaaattatgatcttctcaatagacaagaataaagcaattgagaaatccaaaactctttcactacaaaaacattctacaaattattattagtaatagaaggggacttcctcagcctgataaagagcatctatgagaaatccatgtctaatattttatgtaatgatgaaagacgagtgttttttttttcctaaattagaaagaaggcaaggatgtccacgctcaccatttctatttgacagtgtactggaggttctagacaggccaattaggcaagataaagaaataaatgtcatctattttaaaaaataatttttgtttctatatactagcaataaaccatctggaatttaaaggcataaaacaatagcaattccaatagtatcaaattatgaaatgcttagggataaatcaaatacaatgtgaacaagacatattaactgaaaattctaaagcattgttgagataaatgaaagaaagatctaaataatagaaatacgttatttcttttgtctaaacacaacatacagtgaaaacatcaattctccccaaatttttctataaattgacttcaatcccaacaaaactaacagccttttctttgcagacttcacaagttaattataaagtacatatggaaatacaaattacctggaatcgccaaaataaatttgataagaaagaacaagtttggaagacttacattttctaatcccaagacttattacaaagctacggcaatcaagattgtgttatatcagcatcaagatagacaaataggtcaatggaacagaataaaatccagaaatagacccttacatacatgaacaactgatttgcaataaagctacagaggcataggagtggaggaaatatagccttttcaacaaattttgcttttaaaattggctatctatataccaatcatatccatatgagttatgaactttgatctatacctcatactacatataaagattatctttaaatagataagagaccaaaatgtaaaaccccaaactataatatttctaaaataaaacaaaagaaaatgtttacaacctatagatttcttagacatgacaataaaaccatgataaaaaaataggttttatgaaaattaaaatctctgctcttcaaaatacattgttaagagaatgaaatacagggcatatgccagaagaaaataattgcaaatcattaaggactttataaggatcatataaataaatcataaaactccataatgagaaggcaaacattcaattaagaataggcaaaatatttgaagagacacttcgccaaagaagatatacaaatcacaaacaaatataaaaatgaatatcattactcattacgaagatgccaaataaaccacaataatatataattacacatctattagcatggatataagtcccacatcctgggaaactcctcagtcccaggaaaacctgaatggttggtcactctaaattacaattaaatagaattttataaaatgcagactaatctgttaatgacaaattatgtcaggtattacctaggaatggaaggtgaggagggatctagggagtgaggaattacgcaggggcacaaggaaactttagagtgttgtagaagtgttaattctcttgattgtaatgatggtttcaaggatgtatacgaaggtcaaaaagcataatactgtatgctttaaacttgcgtaatttattgtatgttaatttacctcacaatgttgttaaaaataaatgtactgacttggctgtatcgtgaaggtctcatatgtgtttctttcattaagttctggtaattttatatttccattgtgatttctgatttaaatcataagttatttagaagcatgtgtttaattttttaaaatatggtcatttctatttatcacttttattattagtttcttacctagttttgtggtaataagagatcaatctgtatgatacctaattctttgaagtttagtaaggctttcattacagcctagatcatcatcattgctttttggtacatttttcacggatgagaaaaatctgtatcctataattgttggctaaaactttacatatgtccatagatcaagccaatatgactttctctgtcattcatgaaaccagtccttctcaatctcgttagacttgataactctctttactttgtgctaattagcatatgttttctattactattgcgacatttattcacaaaaatataatatcacttgtttgctgagcttttacactgtattttaatgaggaaagagaattcttccttagtatcagaaattcccattatgaaaaactcctatctgtaccctattggcaggagtagtgctcatggctatacttataaccctgtggaggtagctaacaaaacaccggatgtctccatctaattaaagaagaaaaacagggcctcacaggaggcactaaagctgggtaagctggaagtcaggactgctgtgaagcgggatttaataggatctggtggtacagccttttaataagagacacctagtgctgcttctctcctctctccacccaaatcctggcatcctcaagaaaccatgatgcttgtggatactacacacttcttagttgaggtgaagtgcacagggtgatgagaagagtgtcctggctgatgggaaccagggttcacagccccatggagacatctcttttcctgaaaagaagtatgctatttacaaagtctagtaatacctgattgagtcttgtgcttagcccctgaggccaatgatcagcaagaggatagagttggcagcttggcatctagcaacggcccagatatgctcagcccaaagaattgtttctgaaagcccacttagctacattcgtcagtcttttgactgacctctgcacagtttccagcgactggcattaactgcaaagcaccctgtgggtagacttgacaagccaaatctccagttgcactatctctgcatgtttaaattgccttaggtaatatttcctcctgacattctagatctgacaaagctttgtagaggaaacttctccttcagtattacaagcttctatgagctcaattataatcatgtatattgtcatgagaagttctaatgataattttcagagttattattgtaatacttaatcctaatagcaattgttaacaagggtgataaccacagggacctcacaatcacatttatgatgatgaatcaatcttgaaagaagttgaaaaggagaggcgttgtaaagaatgtatggaagcagctggatggttgagaaacatatttactacacagccttcttgctcttggggactgtaatgaatgcgtagaagtacaagacacagtgcccaccattgacataccagtttagtggaggaggcaaacatatccaccaatggtgatttgttgcttgacaactctagtgaacagattcctgggtcatgacctacctccttagaatgctgaaaggaaacctcttcaccagcagagtgctttgctcatagtgggtattcactggtagtgagcactctgcctttctctgttacgcttctctttgcttcctgcccatccagtgctggctgccagacctactagcacttcgtctatctttccattttctcctagtcattattcagccatgaaaagtttagcttaactctctcaccggatccccaaacacctcagagctagtctcaggaaacaatgttactagaggtaaggggaagcactagagaagagctgaataacctgacaatcatgttgggcaatgctagtacccaagccactgccaggctctggcaaaagaggggagtaagataggaagaatatattctctaaatgcagatggctgtagaaaaaaaaggaggaagcaaactggccatcacaaaaggggatatgaaatgaatagaggggtttagtaatttcttgagttagtttcaagaacccatgaaatgtaccaccttagatgcattcctttgatattatgcatgtggttggttcctgcttttccatgacaaggactggtctttctttcttttttttttttttaactgaactgaaaaacctttatgatagaactgacattacatttaaaaaagtaaaacaaccctccagtatcacagtcttccttttgttgcccagcttcaattgcgtccaaaaatatctgaggccctggaggactcacttgtagataaacctgagtgtcctacaatggcattcaattcctttgtacatgagtcatttggttgcagttttatttaaaatcagttggaaatgtttaatcaaagtattcaaaaattggaaacccaaaaaaactgaagcttttagaaaactgtaattattgaaagcaaagcatgaatataggcattgaaatttgttcttataaaagcatggaataaacagaataaattaaaatttgaaagctcaaaaatgttttaaatttatattttaagttcaggggtacatatgcaggtttgttccataggtaaacttgtctctttgtttttgtacagattatttcatcaatgaggtattaagcctagttaccattagttatttttcctgattctttctctcttcccactctccaccctctgataggccccagttgtgtgtagttcctcactatgtgtccatgtgaaagacttggaaccagcccaaatgtccaacaatgatagactggaataagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccccatattctcactcataggtgggaattgaacaatgagaacacatggacacaggaaggggaacatcacactctggggactgttgtggggtggggggaggagggagggatagctttaggagatatacctaatgctaaatgacgagttaatgggtgcagcacaccagcatgacacatgtatacatatgtaacaaacctgcacgttgtgcacatgtaccctaaaacataaagtataataataataaaaaaaaacaaaaaaaaacaaaaaattaaatcttacatacaatttgagctttccataagaaagaatgagatcatgtcctttgcagggccatggatggagctgaaggccattgtgcttagcaaactaatgcaggaacagaaaaccaatactgcatgttttcacttataaatgaaaggactggtctttctaaagagttctagtcactgcagtcagtaaaaaaggcagtttgacataatggttaagattttttctccctggagtcagactgcctgggatcaagttttagttctgctacttgccaactgttatcttggataacttcactacaaaacttcatcacagcttctttgtttgtgaggcaggacaatgataatagtagcacctatatcctaggcctatgagaatgaggaatacatgagtgaatatgtgtaaagtgctcaggaaagggtctggcccatggtaagcactcaatgactgttatcagtgcctgttgctgaggactaggatgtaagggaaagcaagctggagggagagaacacatgcatgggataatgcctgtgaatgaaactgataactagaaattgggcaatttaaaattatttgttgggatgatttctcccgagcctttctctcttccgtggtatgtgatattttcaagaatatgatttgcttttattttggcctaaggccacctcaagtggtaaaatcccttcatgtcctgccccagcttctttccaattccactctgctcttaggtccaccagctccaatatcatgccagctaactgctactgccttctttatcctcattgccccttttcctctcttctcttgttcaaactgtcactcttcaaaagtgtctcctcgcccacttgtgtcatttgccctgggcaattctactggcgaggaccttctagaagaggagagaaaactcctgctgcacttggcagggtctgctatgcagtgactcattggagtggttaagggatgtccagaagctggttctcagctatttttccaattcagacaatgttacggccctagagatgactcattccattgtttatttgcttacttcatgtaacatgcgccttgttctgccaggccctgtgagggctacaggtgtggttgtgtgcctgtgtgtgagagaacatatgtggacatgtgtattcatgtgtacatgcacatgcacaagtgtgcatgtagggggcacaatgcaaattcatcccactcagagatcaggctctgggagacaggctgatttggcaggtgctagatgcctactcctccatttccattgaaaggcatggtagcctaaaagtcatacacataccctccttttctgataagaccacttgggatcagacatcagtcctgggagggtagctactttgccaatccaagttctccctttgtaagattcctttccagcctccaacaaagtcgattataactaacctttctctaccagatgatataaattttgctaccgttccagtctttcttcttttttttcatacaagatgaacacttttcttttatcagttatcaagattacttgctgagattcaagtaacagcagactccttggagggcatatgctcaccaatcatctcagcaacatggcacaaagatgtaagctcctcaagcaaataaggcctctagggaattttaatgtctaaattaatattttctgaccctatccttagattcagattttctgcagtcaaatccttataaccaagttagcaaagccagtaagaagcaggggtgaaaaggggtgcttagagatcatctagtttaatcccattagtggacaaatgggaaatagaaggttcagagtaagtaactgacccattaaaagtcatagatgaagtgagtgacagtgccggactaggactggatctccttccccacaccccacccccacctcctggactaaggctcttcatacctctctgtgccctactctgaagattatttggagctgcagtctttacttctgggcttctccattgagtccatgagctttaagactcacccagggcataggataggattatgaaactcagtcaacccatctttaaggagcctctgatgggatttaaataaagaagaggaccctgggttttaaggcttggaagccattcagatggattggctgtacatgtgtggcactggggaaagagaaacccatatcccaaggtagaaatgggatggcagactgaaataaaaaggcaagctagcccttctgttagctttctgagcccatagactttccctgtgaactgttgagtaatgagcagagttagagaatagactagcagataacagaagtgtattgctaaggccgggcatggtggcttacacctgtaatcccagcactttaggaggctgaagtgggcagatcacttgaggccaggacttcgagaccagcctggccaacatgatgaaaccctgtctctactaaaaatacaaaaattagccaggtgtggtggcacacacgtgtaataccagctacttgggaggctgaggcacaagaattgcttgaacccaggaggcagaggttgcatacgtacccttctatacttctataccatacttctacactttcatgaaacaacacaaccactctatgtgtctgtctgataagaacagagtatcctctgtacaaaagtagacattctcatcctttcttcaaagtgaggagatggaaagaccctaaaatttttgcatctacttctgggaaacaatcacataatctggctctgagatatattaatttctccacaaattcagtcacagtgctgaatattcttttataaaaagataaaattgtaaagttaaccaccaaataaacttgtattaaatagtatgaggaaatataagagaaaggaaaaaatatgaatagctattataatccatgtttctgtaccttgtcatgagaccatagtggaatttttaacttgctctttgccttcacctgtgacctcaactggatggaattctttatctggtagcatgactcaaaccttcatccctgaaaaatctgaagcttaatggtcctaccttttttttttgttgttgttgttactataatttcccattaacttttattttggtggaagtacagtcatgcattgcttaatgatggggatacattctgagaaatgcatcattaggcgattttatcattgtgtaatcatcatagagtgtatttagacaaacctagatggtaaagcctaccacgcacctaggctacatagtacagcttattgctcctaggctccacacctgtacagcatattactgtattgaatacaatgcaggcaattgtaacaaaatggtaagtatttgtgtatctaaacacatccaaccatagaaaaggggtagtaaagatacaatataaccttatggaaccactgtcacatgcatgatctatcattgactgaaatgttgttatgtggtgcataactgtatttaaaaaaggcacaggagaatctccactgttccagatatagtactctctgccttcattatgtagcagcaacccaattccacttggttatcaggatcaatcataccagccattataataatccttctttacctcatggttcagtagaatgaagatctcaaaatgatcaggtcattgtctcaccttacaattcaatggaatgagactccttgattcacactctgggtgttatggactaaattatgtacctttaaaatttatatgttgaagccctaactccccgtctgattgtattggagacagggcctttaaggaggtgattaaggttaaatgtggtcataaggatgaaaccctgaaccaatagaacaggtattctcataaaagaggagagagacccagacatcactcttttttcatgtgaagacagagtgagaaggtggcctttgggaaactaagtagtagaccctcaccagaactctactggaacgtcaacttcggacttacagcttccagaattatgagaaaatagatttctgttgtttaagccacccaatctatggaattttgttatggcatcctgtgcaaactaagacaactggttcctagttcaaagcatatagcacatcctgtaaaatagaaccacaacatttctggttgttttaaccccatagtacactattatatcattgtattatgccagatacttctgagtaatgaggtatgtggtaaaacagtgaattacttcagcatgagcacattttcaattattttgcagtgaaatgatttccttcatcaaaagcaatactacgttcaattactattatggttgattaggcaaccaataagttcatgaactgtgatgttcacagaagtattttagacagaggagccaaactcatattcataacatgtcaattccagtggggatgaaccacttctttctcattgacggaataaaggccattataatcaagctgccaccacatggctagctggtctcccccaaggaaatgttgccatgtccagggctcagtactcttctcttatgttgacaggtaaggtaatcaacagtcatagtaaccagataagttgttgagcctatttgttaacttctatccctgccactacagccactctgtttatggaacctgttgagtaaggatttgcgtgactaaaaaaaagggccaacagaaattcacagaatgtgttttttttttgtccacataattattgaaccttctctgcagtatatgccctttagtgagcattcatatgacatacaaataccttcacgctctgtgaccattctgagtggtctttcattgtcaccaatcttccaattgcattctttcaaagtccctggccatacagccaaatcattaagaagtgataacaaattagtaaagactggtacctctggacatcttttattccagactaagtaaacagcgaaacatacagcatgaagctttgccaactgggaaaattcccttcacccctatctttcagggctacctctgagtggggctttaacgctacacctgtccacttccagaatatcatgcagaaatgtctataaaatagatctgatatttccttctcagtcaactggtctatattaagccatagttgtaaatacagtgagaagattcaatatagcaggtatcagtctgagtcacttgcttatgcaacttacctgaattttccaggcctacttcagccttacctgttatatatcatttccagctgatgatcaatttctgctgtgccgtatgtcatcctgatggaattgtggaacagaaaaggaaaattaggtaaatactaaggtaatctgaattaagtatggactttagttaataataatatattaatgtgggttcataattatataataatatattaatgtaagatattaaaataaggaaactgctatggaatatgtgagaattctcaatactgtgttcacaattttactgtaaatagaaaattgttccaaaaaatgtttactaaacaaaaaaggaaaaaggaatagaacataacaagcatcccagaaattcccttccgacttttctaacttccctatccaatcaacccagagataattactcttctgattttaatctcattgttttgcctgttttgaactttataatagtggaatcacacagcatcacacagcatgtattctctatctgacctattttattcaaattatgtttgcgagattcccttgttacattttttattttaaatttttgtgtgagattcatttatgttgttgcttttaatagtttatttattttcattggtatatagtatttcattgtataaatgtacaacgatttattttgccattatagtattttaagagatttacgtttttttcagatttaagctaatgctactatgataaaatgctactatgaacattcttgtgtgtgaattttggtacacattcttatttgtatatgtagaagtggaactggtggttcatagaatatgcatatgcctagatttggcagatgcctccagtcttttcaaaagtactaatacaaaattccatttccacctagattatagaagcttggaaaaacattgctcccaccttaacaccaagagtaataaggtaaagtacaaaattctaatatttcttgatacaatcagtaatctgaggtcacaaagagagacacgatatgtgtaccagttcatctgcatcagagcataggagaaagaagtactagtggccatacaaacaggtaagataatcatttaacttttaacaaattccaaaggccgagcatgtctagcatgactgtacaggatgcctgggagccctagacaccagagaactttggactcactcatgaactcttttccttgaacctctactgggttttttgtcagaaagattgattccggtgtgggagaacagagtccaccttggtggtgcagacacgtaagaaggtattggatgtcactgcacaaaaaccaagatgaccaaatattctcttcaaaatcttccttcacatgaagcaaaatgcttaagtcaccaggaacaagagaagctaattttgttacctacagagataggtaaacgcaaattactgcttggaaattgatagaggtccctcccaacttccccccgccccctaaaaaaagcaaaacaaaaacaccgtgggagagtggcagaaacagttctgagctaaagaggtctagcaatacaattataattctacagtgactaaggaagaggcagaaaactgtctctgccaccaaaacaaggcagaggttggctcctatggagaggagaagcaggaaaggaacacagaggaaacaccatctttgagacctagccacacagattctgtctaaaactgaggttgggccatgacatccacaaactttcctcaattattagactaataaacatgaagcttccaccttaagaaaataaatgaacaactgaatgcacagtaagcagagaaaaataataataaagataggaaatcaatggcattgagggagaaaagcaatacagaaagatcaatacaatttttttgaaattattgataaaattgataggataaaccttttgtatgtgtgaaagtgagagaagacacagtttagcaatatgaggaataaaaaggcactattaatacagatcatgtagaattttagaagagaaaagaagaatactgctgagctacatgaatgaacctcaaaaatgttctggtaagtcaaaaagagaacacatactggatggatttatttatgtgaaatatccagaaaaggcaaatctatagaaacagaaattagtattttcctgggtctggggatgggaatggggattgactgcaaatgggcatgagtgatctttttgggattatggaaatgttctaaaattgaacttagatgattgtatgattctataaatttactaaaaatcattgaattacacacttgaaacaggtgaaatttgaggtaggtaaattctttatcaataaggctcttaaaagcataataagggcctcatataattgaatttatcccaacaaaattggtaactgatgaaaaaatagacaaattctttgaaatatatgaaccaccaatgctcattcaggaaagaatagataatctaaatagttatacatttattaattaaggataaagaagaaaaataatataatatcaatagatgaagaaaaagcagttgacaaaattcagcaccaattcatgataaaattcctagcaaattaagaactaaaaagaacttgttttactcagaaaagtttatatacgaaaaatctacagttcacgttatacataatactgaaatgcactatgctttccttttaagattaggataagacaagaatatgcactctctctgcttatatttaacattattttagggatactaaccagtgcagtaaggacatttaaaaagcacacatattagaaaaaaaattaaactgagtgtatttacagttgactgaattttctacttagaaaattccaaagaattcacataaaagccattggaactaataagtgagtttaagaaagttgcagcacacaaggtcaatttaaaaaatcaataatatttccatatactggtaatgaatcactaaaattggaaaatttttaaaagtaccgtttacaacagaagcaaaatatgtgaaatatatagggataaatttgacaaactgtaaggaaaatttgtatgctaaaaattgataaaacagtggtttgagaaatcaaaaaaagaccaaaataattggaaagctatgccaaattcatgtatttgaagtttcaatgttattaagatatcaattctcccaaatttatagatttgacataatcccagtcaaaataccagcagggctttggattttttaatagaaaactataagctgattttggaaaagcaaaacaaagcaaataagcaataagtagaaaagccaaagaaattttagaaatgaagaacacagttggaggattcaactacttgatttcaacactcactataaagctgaattaaccaagactttgtgggattggccataatacagacaaacagatcaatgggacaaaatagagttagcagaagaagatgcacacatatacagtaaatttattttcaacggagatgtaaaggaaatttagtgaagaaagcatagtgcttttagtaaatgatgctggaagaattgacatttataagaaaaataaaagaatcttgacctttattttatgccatatacaaaatgaatttgcattgtatcatagacttaaatatataaacaagaactataaagcctctacatgaaacataagagaaaatatttgaaaccttaggttagacaaatatttttttagataggacacaaaaagcaagagccataagagaaaaactgatgaattagagtttatcaaaatttagaatttctattattcgaatgacattaaaagaatgaaaagacaagccacaagcttggaaaaattgtttgcacatcacatatttcataaagaatgtatatatggaatatataaggaaaccccagactcaataataagaaaacacactattgaatatattaattgacaaaatatttgttatatgcttcatcagagatatagatggcaaataggcacatacaaacatgttcaacataattatgaggaaatgcatatttaaatcaatataaaatacccctacatacctattagaatgttttttaaaaaaacaacaataaataccaagtgctagacaggatgcagttattagaattctcacacattgcttatggaaatgcaaaatgatacaaccactttgtaaaatagtatagcagttacttataagtttaagcatatactacactatgacacatcaatttcattcataggtatatattcaaaagaaatgaaaaaatcaatgttcatgtaaaatcttgttaatgaatgttttagcagttttattcataaagaacaaaaatttgaaaaacccatatgttcactaactggcgaatatataaacatactatgatacatccctaaaatggtatactactcagcaataaaaagaagtgaactactgatacatacgacatttatgaatctcaaatgcatcttgctatgtaaaaggattcagaatcaagtctaattactgtatctgtatgatttcatttatatgacattctctttttagtattcttccacttttataaaaatattttgcaaaatagccagtacctagtagagcttgcattttacccactttatctgacttagaatttatctcaaagggacatacagaccagtatacagagacaaccgtaatagaatgctcacagcagttttcataattcagaagaatgatgaaaacaaggtaagaaggcaacaacataaaattgatcaaattatgctgacattttatgtgcacatatacttggaaatggtaactatgtgcacattgaaagtgatagagtagctgggcacggtggctgacgcctgtgatcccagcattttgggaggccaaggcgggcggatcacgaggtcaggagttcaagaccagccctgaccaacatggtaaaaccccgtctctactaaaaatacaaaaattagccgggcatggtggcacgtgcctgtagtcccagctactcagaaggctgaagcaggagaactgcttgaacctgggaggcagaggttgcagtgagctgaggtcatgccactgcactccagtctgggtgagagagcaagactccctctcaaaaaaaaaagaaaaaaaaaagagtgatggagcagaatatttgggtaagtgaaattaatattttaaatatatgacatttttgataaggcaaagctatatggacagaaaacagatcaaagttaaccaggtgctgagtggggagaggagatttactacaaaaagaaataaggaatctttttagggtaatgtaaatgttctatatcttgtagtggtagttatataactttatctgtttgtaaaaattcatagcactgtatatctacaaagatgattttattgtgtgtatattttatatccataattgagaacagaaaaaatgtaccaattacattctcaccagcagtcaatgagagatccagtttctctataacttttcagcacttgctaatttctgcctctttttttaactgttctgatttgtgtaggcagtggaatttcatcactgttttaatttgaatttccctgatgactaattattttcagtatcttttcatatattagttatttgtttattcttcttgctgaagtccctgtgaagtattttgaccattttggtgaggggaggatttctgtctttttcttaatgattttctggagtatttgtgtataaaagcacacacaaatacattctggatgcattgtctaatatatattgccagtatattagtccactttatggcttgcaagtttttatcttttaatggtatcttttgatgatcagtgttcataatttcaatgaggtctaaattatcaatatttttattatgccttttttctaatttaagaaagtattgcttactccaaagtcatgaagatattctatattatccttaaaaagtttaattgttttaatttttgcatttatgcttactatccatatggaattgatctttgtgtatggtgtgatatactcgttaggatttgatttttttttccccaatgcatgggtaacttatacattcagaccatttgttttaaaaatcatctattcccctctggattaaagagtcatctttgtcataaatcagaagatcttataagatctatatatggatgattacggactctattttgtttcatctatttgtgtctctgtgtcaatgccacattgttttaattactatacctttttttttaacatgtcttgctatttatcattgtaagccttcctattttgttctttcccttcaagatacactttgctacttttggcactttgatttccacatatattttagagtcaggttattaagttctccaacaacaaaaaataatactaagattttgattctacatgtactaactatggcttaattttgagacagttgacatttttccaatattggttaccaagtcataaatatggtaaatccatatctattatttaacttttgctaaatattaacttcaaaaattcctatgtaattaaacaacaaagatatatttctcattcagggtctgtagattggctgtggatcaagaccaggttaatgattagattcatgtcttttcattccaaaatacaaggtttcttcatgtcttttctcatttattttcaaataccaaacaaatactgcattcttaaaataaaccccactaggtattctcccttttctatgtctgtaggttcagtttgaaaaagttttatttgggatttttgcatctatgaggaaggtaggcctatactttttctttcttttggaacccattttaggttttggtatcaatacttttcaggtctcataaaatacgtttcaaaatattatgtttgtttactattcttggaagaatttttctaagattcatgtttcgttgtttaattgtggtaaaatatgcttattaaatttgctatcctaaccattttaaagtgtataacccagtgacatttaggacattcacagtgttgtgtaatcattatcgatctagttccggaacatgttcattgaccgcaaaaggaaatctcatgcccactaagcagtcactctctctataaaccctaccaccaggacctggaaagcgcaaatctggcttttgtctctgtaaatttgtctattctaaacattttatataaaaggaataacataatacggtgttttcaaggtttatcaatgtcgtagcatgtaccagtactccattcctttatggcttaataatatttcattgtgtggatatatcacatgttgcttatgtattcatcatttgatggacatttgagttgcttctgcttgctggttattatgaataatgctgcttggagcactcatatacaagtatttctttgaacatttgttttcaattttggggggtatatacacaggactagaattgtttggtgaagtgataattctatgattaacttcttgtgacacaaacaaatggagaaacatcccatgctcatgaataggaagaatcaatatcattaaaatggccatactgccccaaataatttacagattcaatgctattcctatcaaaccaccaatgacattcttcatagaactagaaaaagtaatttaaaattcatatgaacccaaaaaagagcccaaatagccaaggcaatcttaagcaagaagaacaaagctggaggcatcacactacccgacttcaaactatactacagagctgcagaaaccgaaacatcttggtactggtacaaaaacagatgcataaatcaaaggaacaaaatagcccagaaataaggtcatacacctacaactatctgatcttcaacaaagtcaaaaaacacaagcaaaggggaaaagatttccttgtcaataaatgtgctgggataactggctagccatatacataagattaaaactggacctcttccttataccatatacaaaaataaactcaagatggatgaaagacttaaatataaaacccaaaactataaaaaccctggaagacaacttaggcagtaccactctggacataggaatgggcaaagattttatgacgaagacaccaaaaacaattgcaacaaaagaaaaattgagaaatgggatctaattaaactaaagagcttccgcacagcaaaagaaactaacaacagagtaaacagacatcctacagaatgggagaaaatatttgcgaactatgcatccaacaatggtctaatatccagcatctattaggaacttagacaaatttacaaaaacacacaactgcattaaaaagtgggcaaggcattttttcatgtgttttttggctacataaatgtcttcttttgagaagtgtctgttcatatcctttgcccactttttgatggggttgtttgtttttttcttgtaaatttgtttgagttcactgtaaattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaaatccttgctcatacctatgtcctgaatggtatggcctaggttttcttctagggcttttatggttttaggtctaacatttaagtctttaatccatcttgaattaatttttgtataaggtgtaaggaagggatccagtttcagctttctacacatggctagccagttttcccagcaccatttattaaatagggaatcctttccccattgcttgtttttctcaggtttgtcaaagatcagatagttgtagatgtgcagcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcaatgtgggctcttttttggttccatatgaactttaaagtagttttttccaattctgtgaagaaagtcattggtagcttgatggggatggcattgaatgtataaattaccttgggtagtatggccattttcacgatattgattcttcctacccacgagcatggaatgttcttccatttgtttgtatcctcttttgtttcattgagcagtggtttgtagttctccttgaggaggtccttcacatcccttgtaagttggattcctaagtattttattctctttgaagcaattgtgaatgcgagttcactcatgatttggctctctgtttgtctcttattggtgtataagaatgcttgtgatttttgtacattgattttgtatcctgagattttgctgaagttgcttatcagcttaaggagattttgggctgagacgatggggttttctagatatacaatcatgtcgtctgcaaacagggacaatttgacttcctcttttcctacttgaatgccctttatttccttctcctgcctgattgccctggccagaacttccaacactatgttgaataggagtggtgagagagggcatccctgtcttgtgccagttttcaaagggaatgtttccagtttttgcccattcagtatgatattggctgtgagtttgtcatagatagctcttattattttgagatacgtcccatcaatacctaatttattgagagtttttagcgtgaagggttgttgaattttgtcaatggcgttttctgcatctattgagataatcatgtggtttttgtctttggttctgtttatatgctggattacatttattgatttgcatatgttgaaccagccttgcatcccagggatgaagcccacttgattatggtggataaggtttttgatatgctgctggatttggtttgccagtattttattgaggattttaagaaatgcaaatcaaaaccacaataagataccatctcacaccagttagaatggcgatcattaaaaagtcaggaaacaacaggtgctggagaggatgtggagaaataggaacacttttacactgttggtgggactgtaaactagttcaaccattgtggaaggcagtgtggcgattcctcagggatctagaactagaaataccatttgacccagccatcccattactgggtatatacctaaaggattataaatcatgctgctataaagacacatgcacacgtatgtttattgcggcactattcacaatagcaaagacttggaaccaacccaaaagtccaacaacgatagactggattaagaaaatgtggcacatatacaccatggaatactatgcagccattaaaactgatgagttcatgtcccttgtagggacatggatgaaactggaaaccatcattctcagcaaactattgcaaggacaaaaaaccaaacaccgcatattctcactcataggtgggaattgaacaatgagaacacatggacacaggaagggaaacatcacacaccgggtactgttgtggggtggggggaaggggagggacagcattaggagatatacctaatgctaaatgacgagttaatgggtgcagcacaccaacatggcacatatatacatatgtaacaaacctgcacgttgtgcacatgtaccctagaacttaaagtataatagtaatgaaatttttaaaaaaagtggccaaaggacatgaacgaacacttcttttttcttcaacttttattttaagttccagggtacatgtgcaggatgtgcatatttgttacataggtaatcatgtgccatggtagtttgctgtacagatcaacccatcatctacatgttaagcccagcatccattagctattcttcctgatgctttcccttgtcctgcactgcccataggtcccattgtgtgttgttccccaccacgtgtccatgtgttctcatcgttcagcacacacttacaagtgagaacatgtggtgtttggttttctattcctgcattaatttgctgaggataacagcttccaggtccatccaggaaagacgtgatctcattcctttttatggctgcctagtattccatagtgtatatgtaccacgttttctttatccagtctccagtctctcattaatgggcatttgggttgattccatgtctttgctattgtgaatagtgctgcaatgaacatacgtgtgcatgtatctttataatagaaagatttatattcctttgggtatatacccagtaatgggattgctggtcagatggtatttctgcttcttgatctttgaggaatcaccacactgtcttccacaatggttgaaataatttgcattcccaccaacagtgtaaaagtgttcctctttctccacaacctcaccagctctgttgttacttgactttttaataacagccattccaggccaggcacagtggctcatgcttgtaatcctagcactaagggaggtcaaggtgggtgaatcagttgagatcaggagtttgagaccagcctggccaacatggtgaaaccccatctatactaaaattacaaaaattagccgggcatggtggcatatgcctgtaatcccagctactcaggaggctgagtcatgagaattgcttgaacctgggaggtggaggctgcagtgagcagagatcatgccactgcactccagttggggcaacagagcaagattccatctcaaataaataaataaattattttctgactggtgtgagatggtatttcattgtagttttgatttgcatttctctaatgatcagtgatgttgagcttttttttcatgtttgttggcctcttgaatgtcttctattgggaaagaacacttctcaaaacaagagatacatgcggccaacagaaacattacaaaaaatttcaacatcagtgatcgttgagaaatgcaaatcaaaaccacaatgagataccatcacacaccaacgaaaatggatattattaaaaagtaaaaaaaaaaaaaataacagttgctggtaaggttgcagagaaaagggaacacttacacactattggtgggaatgtaaattagttcaaccattgtggagaatagtgtgatgattcctcaaagatctaaaaacagcagtaccattgaacacaacaatcacattactgggtatatgcccaaaggaatataagttgttctattataaacacacatacacacatattttcattgcagcactattcccaatagtaaaagacatggaatcaacctaaatacccataaatggtagactggataaagaaaatgtggcagatatacaacatggaatattatgcagccgcaaaaaagaatgaaatcatgttatctgcaggattgtggatggagctggaggtcattgtctttagcaaactaatgtaggaacagaaaatcaaatattgcatgttctcacttataagtgggagctaaatgatgagaacacatggacacataaaagagaacaacacacactgggacctaccagacggtggatgttgggaggagggagaggatcaggaaacataactaatgggtactgggcctaatacatggatgacgaaataatctgtacaacaaatccccgtgacacaaatttacctatataacaagcctgcatgtgtacccctgaacttaaaataaaagttaaaaaaattctgaggcgctttataagaattttgaaagtccctttagtgtataaattcttagacattttgtcattctgttttatactattctagcaaatattaagattgccaaagaacaaaatcttaaccttcattttagatggaggttgagtaatctcattttgtaaagccatgttctttggtatgatgtaaaagttctattgcttagcttaaaaagggaaaataaataattgagaaagtccaggttaaactggattcaatttccaatagttaatttacgtttcttcttcgtaagtctttgtttgattctacttaagtgttttcaaccataactcattttttcaaattgtgtcaaaacataataggagcaagtgcagaaagatcatgaaactctatatacatttaaaaaacaaaaacttctttaggcactgccaaacagatttccaaaggggccgcaacattttgcattcccacctgcaatatataagggttcaaatttctccatatcttcaccagcacttattatcttccatttttatttctttagtgtcaaccatcttagtgaatgtaaactaacatattattgtggttttgatttgcattttcctaatgacaaacgttgaacattttttaatgtgcctgttgtccatttgtataccttctttggagaaatgtctcttcaaatcctttgcttattttaattgggttgcttgtcattttgttgttgagttttagcttttctttacatattttggatattagacacttatcacatatatgatctttaagtatttttaccactcaatagtttgccttcagtttcttgatagtgccttcccattgacaattttcaaaattttgatgaattccaatttacttatttattctgttgcttcgtcatattttaaaaatctgttgccaatttcaaggtaatgaatatgtacccttatgttctcttctaagaattttatagtttcacatcttgcatttatatctttgatccattttgagttaatctttgtatattgtgtaaggtaagaattctacttcattcttttgtatgtggttatacaattgtcctagcatcatttgttgaagagattattatttcctcctttgaatggtcttggaaaccttgtcacaaatcagttgaccatacatgtatctatttttgtttggattctcaattatattccattgatttatatgtttatccttatacccatacttgaccattttgattactgtagctttttaatatgttttggaatcaggaagtgtgagtcctccaaattcactcttctttttcagtattgttttggcaattcaaggccccttgtaattccatatgaatttcaggatcaacttttccatttctgtaaaataggccattgagatttttatgggatttgcaattaatctacttatcactttagaaagtatagacatcttagcaatattaagtcttacaatccatgaacacgaaatgactttccttttttttaggcaattcacacttaatttctttcaacattttaaaattttcattgtaagagtcctacacctttgtggttaaatttactactcttttatgttttcatgctattataaataaaattacattcttaaattttttttcagatttttcagtcctagtgtacgaaaatacaactaatttttgcaagttgatccgtacctagaaactttgcagatttcagttattattatccttaacaacataacatttgtatatattatttagtatattctttacttgtaggattttgtcatctgtgaataaagatagttttaactatttctttattatttgcatgtcttttgtttctttttctttcctgattcatctggctataactttcactaaaatgttgaattacagtggtaaaggtgggcatctttatctattaatcactcatctaattcacttaccctgtcttctgttactctaatctcttgtttaacccctatattaagttcttcatttgagttgctactgtttaactctacaattatctatttattattttataggttctagttctatggtgaacttttatatgttgtaatttatgtccttaaacatattaatcacaattaaagtatgtgctaatagctccattttatgtatcatttgtgggtctcttattattgcttgttttgttcgcttgatattttgattatttggttttctcttctgacaagacttgtattttttaaaaatttgatgtcagatattatatttgtgtgtgtatatgtatacaaaataatgtggagtcactagattagatcatctactcacagagaggttttatgtcccttatggcatgtgcaaggacaagtcacctgtgcccaactatggattaagattacttgagggtgagctagcagaagaaaataaataactaagattagagaagaacttaatgaaattgtgatgcaaaaatttatacaaaagattaatgaaacaaagagttggttctcaaaaaataaataagattaatagacctctagctagattaacaaagaaaaagaaagagaagatcaaaataagcacaaccagaaacaacaaaggtgacattacaactgatcccacagaagtaaaaagatcctcagagacgactatgaaaaactctatgtatacaaattagaaaatctagaagaaatgaataaatttttggaagcacaaaatctcccaaaattgaatcaggaagagattgaaactctgactagatcaacatcaacttctgaaattgaatcaataataaagaaactaccaaacaaaaaaagccctgtggcagatggattcatagccaaattctaccagacatacaaagaactgacaccaatcctaccaaaactattctaaaaaatcgaggataaggagcctctccttaactcttcctatgaagccagcatcagcctgataccaaaatctggcagagacacaatgaaaaataaaaacttcagaccaatatccctcatgaacacagatgcaaaattcctcaacaaaatactaggaaattgaatccagcagtacatcaaaaagttccaacaccacaatcaagtaggctttatttctaggatacgaggcttgctaagcatatgaaaattaataaatgtgattcaccacataaacagaatcaaaagcaaaaaccatacgatcatctcaatacatgcagaatatgctttcaataaaattcaacatcccttcataataaaaactttcaacagactaggcattgaaggaacatagctcaacgtaataagagccatctatgacaagcccacagccaacattacactaaatgggaaaagctctaatcattccatttggaaattggaacaagacaaggatgttgactttcacccctcttattcaacatactaatggaaatcctagccacagcaattaggctgtcaaagaaataaaaggcatccaaataggaaaagaagacaatatgattctatacctagaaaatcctaaagactctgacaaaaggatcctagaactgataaacaactttaggagtttcaggatacaaaattaatgtacaaaaatcagtaccacttttatacaccaataacattcaagctgagagtcaaatcaagaacacaatttcatttacattaggcacaaagaaaacacctgggaatacagcttaccaaggaggtgaaagatctctacaaggagaactactgaactgttaaaagaaatcagagaggacacaaataaatggaaaaatattccatgctcattgactggaagaaccaaaatcataaaaagcaatttacagattcagtgctattcttttcaaactaccaaagctattctgtgaagaattagaaaaatactactttacaattcatatgggaccaaaaaacgggcctgaatagccaaggcaatcctgaataaaaagaacaaagctggaggtatcacactactcagattcaaactatactataaagccacagtaaccacaacaacttggtactggtacaaaaatggacacatagaccaatggaacggaatagaagactcagtaataaagctacacacctacaaccatttgatcttcaacaaggccaaggaaaccaagaaatggagaaaggactccctattcaatgaatggtgctgggataactggctagccatatgcagaaggttgaagctgggcccctacctttttatcacaggtagaaattaacttcaaatggattaaagatttaaatgtaagacctcaaactataaaattcctgcaagacaacttaagaaatactcttctcaatatcaaccttggcaaagaatttttggctaaatccccacaagcaattgtaacaaaaacaaaaattgacaagtgggacctaattaaactaaagagcttctgcacagcaaaagaaactattaacagattaaacagtctacagagtacaagatattcacaaactatgtatctgaccaaggcctaatatccagaattcatagggaacttaaacaaatgaacaagcaaaaaccaagtaactccatttacaaatggtcaatggacatgaagagatatgtctcaaaagaaaactaacaagtggccaacaaacacatgaaaaacttcttagcatcactaatcatcagagaaatgcaaatcaaaaccacaatgagataccatctcacaccattcataatacctattattaaaaagtaaagaaatggaatcaacttaagtgtccatcaatggaggattggataaagaaaatgtggtacatatacacaatggaatactatgcagccattaaaaagaataaaataatgtcctttgcagcaatatgaatggagctggaggccataatcctaagcaaattaatgcaggaacagaaaattaaatactgcatattcccacttataaatgggaggtaaacgttgagcacaaatggacataagtgtaggaacaatatacactgtgggttactagaggggagaggtaggtggatgaaaaaactacctgtcgagaaatttgctcactacctgggtaacaagatccatactccaaacctcagcatcatgcaatatttccatgtaacaaatatgcacatgtaccccctgtatctaaaataaaagctgaaaacaaacaaataaaaaacaatagtcattctaatattaaatgtgaaatatggggtgataatgaatctttcagatttaatgtcttaacctttaaaataagggaattgtagcagatgatatttaatagcctttctggttgtttaattatcttcaaccataagagtgtgaaactgtgagagtatgtgggttgaatccgtgaataaatggttgaaattaaatttttaaaaaagattatttgagtgttgatttatgtttttgaaatggctgatctatttcaggttttccaatatttctaggatgttgaccttcacagatattaattttaatactggagtgtttaaagaagctccatccattttactaatctttagttccaattcttatctttccagaactgtgagaatgctgaaatttctgcttagcttttgaggctcttagctgctgctttctatttggctttttggtctcttgtcacatcttgaagatggttgctggagaaaactgacagagaatatcaagatcacgtatgcacaattgtctttcctcaaagatcttggccccttgaatcctagtcttggactctaatttttgttttttaaaccccatgatactgccctgccaaaagttgttagccatcactttctactgtgcttctcagctccatcctgcttataaattgacaattgcctgaaaaagacaactaacagagaaaagtgaactcacctcatttttttcttctttctggaatttcagtaattcaaaattttcctcccttaagtgtgtctatgtgtagctggcagaataatggcccccccgcaaacaatgtctacattctagtccctagaaactgttcatattatcttatatgacaatagggactctgcagatgttattagatcaaagatcttgagatgaggggattatcttgaattatctgggtgggccatatgtaattacaaaattaactataagagggaggctagaagttagagtgaataacaggagatgtgatgtggaagtaagagactggaatatgggcatgaggcaaggaatgccagtagtccctaaaatatgcaaaaagcaaataatgtatcttcccctgaagtctccagaaggaaccagttctgccaacaccttgattttattactttgaggttcctttgtgactacttactatcagaactgaaagagaataagtttgtgttatttcaaatcattaagtttgtggtaatttgctgcaacagcagtaggaaactcatgcactgggttttatgtttctttttcactcgcttggagatttttcatagaagctactttgacatattgaaagcatatttttcttcttatgtcttgtacactcttttttgtaaattctgcccttttgtctctgacttttattctagctattttctttctgtcttccagattattcttccttccactgtgtctactatgctgtaatattacatattttaacttgaaaaagatcaccacaaaaattgatgattcttaaaaccagtgtacagtactcacttaaaacctttgagctctccatttccatggctcgccttttctgcctttgtaagtcttctctcaaaccaagcctccttctcatatatatacaatattatattatatataatgtatattatatattatataatataataaaatatatataatataatcttatatttaataatataatataatataatattatatataataatattatattatattgtgtatatatatatatatatatatatatatatatatagagagagagagagagagagagagagagagagagagacagacagagtcttgcattgtcgcccaggctggagtgcagtggcgcaatctcggctcactgcaacttccgcctcgtgggttcaagcgattctcctgcctcagcctcctgagtagctgggactacaggtgcgcagccaccacgcccagctaatttttttatttttagtacagatggggtttcaccatgttggccagggtggtctcgatatcctgacctcgtgatccgcccacctcggcctccaaaagtgctgggattacaggtgtgagccactgctcccggcctttaataaatgatttttaatattattcaaactctagtttaaataaggccaccttaataaaaggccacacaaccttcctgaaatatttttttggtctttctgataagtctttttgaatataaagacaagtgtcttttagactaaatactctaatttctacaaaatttacgttctgtctgttaaacatgtattttctaataaatttactttcagtttagtctacacacctagtttaatattttgtttaatttacacatctgggttaaagtttttataaacgctcttatcttagtttcttttgatttagtttaactcttctctcttacttgtttctgaaaacatccccaaaacaaaaatagacattctaaatagtaaacacaaaatagctaattaaaaaccactaagacagtcactgccatctaaaatggcagccaaaacccctaatattctctaacaaaattagcaaaattttctttattctaaaaaaaaaaaaatacaaaacaaaattctcaggcattaggacatgccaaatttcctgagactccagccaactacatattgtacacatttttaaactaataaaattacatcaaaaattgaaaatgcaagtagctgttattcaaattctctaaaaaaccactacaattgaatattaacatataaagccctctaagttctccctctctgtatttttctctacctactttacatttttattaatacataatatttgtacacatttatgggttgaatgtaatattttgatacatacatagaatgtgtaatgatcaagtccctttgaacatttatcatatccatcactttgaacatttatcatttccttgtgttgggaacatttcaaagcttctcttctagctattttgaaagatataatatattgttgataactataactaccatactgttatactgaataccaaaacttattccttctatctaagtatacatttgtactcattaacttccctactttaaatctactaacttttctactagtgttgagataaaacttacacttatgactttatagccaaaaaaaaggcttagagatttccaagccaaaaaaaaaaaaaaaggcttaaagacttccaaattaatgactttacaagttacagcaattccataataaccaataacctaaacaccttttattatactttaagttctggggtgcatgtgcagaacgtgcaggtttcttacataggtatacacgtgccatggtggtttgctgcacccatcaacctgtcatctacattacatgtttctcctaatgctatccctcccctagtcctgcacccctcgataggccctggtgtgtgatgttcctctccctgtgtccatgtgttctcattgttcaactcccacatatgagtgtcctaaacatcttttagaaatataaatctaaatttgcctaacaatcacttatggtaataaaatacttaattacaaattaataaccaatgaaaaacctaaataaatgtttatgtttgactctcaaatctagcaagtcagaaccataagctcaaaacaataatatatctctttccaacacaaaaattttgctttttctgccacacaaaaacaaaaaaagccaaaaaacttactaaaattcctcctgatccacatttactaatcaagcgaaacagctgacaaacaaaaattaaatttattactagttcaaaactatttgtttttcttatacaattcagccagtcctaaaaaatatataaacagttaaaaatttaaccctaaactcattttaaaagtaaaataattaagttttctaaaatcaaatttctataaaaactacttgacccacaactttagtccacagctttcattaaattacctatcaagagaaataaagtttagtcatgtaaacaggtcccaattttgttaaaaatatcatttagatacagctatcttctataaaccaataattttatcttactattttataaataaaattctaaaatgaaaataaaatctttattcgtatacatatatgtgttcaagtgtgtttgcacatatctgcatatattgtgttatatgcagtgtctacataataaagtctcataccatcagtcaaaaaacccttaaaagttctattcagctttttccacgctacctagagaggggtccacagggcattgttctggattcctggaatcgcttaaagagaaaatttcacaatgtctggaatccttgatatcctgccaatgaaggaggatgatatcctcaacttgcttgcagcaggaactcacttaggtagccccaaccttgacttccaaatgggacagcacaagtataaaagaaaagtgatggcatctgcatcataaatatgaagaagacctgggagaagcttctgctggcagctcttgtcattgttgccactgaaaaccttgctgatttccctgtcttatcctccaggaattctggctgctgggttgtgctgaagcgcaccactgccactggagccattcctattgctggtcacttcactcctggaaacttcactaaccaaatccaagcggccttctcggagctccagtttctggtggttactgatcccagggctgaccattacctctcacagagtaatcttatgttaacctgactcccattgctctgtggaaaacagattctcctctgcattgtgtggacattgccatcccatgcaacaagggagttccctcagtgggtctgatggtgaatgccagcttggaagttgtacacacacggtaccatctcccatgagcatccatggaaggtcctgcctgatctttacttctacagaaatcctgaaaagactgaaaaggaagagcagacgttgctgaaaagaccataaccaaggaggagtttcagggtgtatggactgctgctgcagctcctgagttcactgctactcagcctgaggttgcagattggtctgaaagtgggcaggtatcctcagtgcttatcaagcagttctctactcaagactagagtgctcagcctgccagggaagattgatttgcagctcccgctgctcagaccactgaacgggtaggaacaacctctgagtgatcttaagctgttcttccacaggctcttatgcaagatagaaataaggttggtgacaaataaatgtcagtttccaaaaataaattttattaaaattaacgtaaataaatacacattcatataaaatatataattaacgcaaatgcctttagttcccatgacttaaatacatctttaataaataaaccagttttaaaacaataaaataaaaatataaatttctttaaaatggtcaacatatatttttacccaagtttactggtcagttttatattcgtctctactaaatattttaatatgtcaagatttgtcacaaatgatgtaaaactacaagcccagccttaaaaaataatctttgtttatgtaactttttactaaatgaaactaatttgtcttctaagttatcaacaaagtactcatgaatttaactgtaaggttcctaaacacctaatatttacaaactatgaaaataatttaccaaaaaccttaaaattataactttgactaatatctcagttttcataatctaaataaactactcaaaattaagttaatataaatacaataaacatcataaactttccatttaattttacatcttaaagttatgtcttgttaagtttgaaaaaatatagctctaagctgtttacaagaggtgcattcttcaaaatccacaaccttgctcaaagtccacggcaagcttacacataaatatccttttacaaggacatctgctcagcaactgcctgtcccaactaggactggcatcacccttgctatggatctttgtggccaaggacaatctcctcattaaaaaacaaacaaagaaacaaacaaaaaaacctttgtcttcctttacttccctgaatacacacatagtttactatgacatgcatattcccattgccatgctgtatctcaaatacatatatttttggtttagagagcttctctctgatggttatttaggttaagagctgttaaattcatctttaagttattagttttagtttatttttaaagttttcaattctagaatatttagtttattatttttcataaggctccattttaattaatattaagcataatagattcatgataaacatattaaaatctatgtctccaaacaccattatatggattgtctgtgtgtttatttcaatttgccttatttgttttgggttttgttcatattgttctgtcacctcctatgcatagctatttaagattgtgtgctgcttgtatgtgtattgtggcactgttcacaatagcaaagacttgaaaccaacccaaatgctcatcaatgatagactagataaagaaaatgtggcacacatacaccatgggatactatgcagccataaaaaaaggataagttcatgtcctttgcagggatatggatgaagctggaaaccatcattctcagcaaactaacacaagaacagaaaactaaacaccgcatgttctcactcataagtgggagttgatcaataagaacacatggacacagagatgggaacgtcacacactggggcctgtcggggggtgggggactaggggagggacagcattaggagaaatacctaatgtacatgacgggttgatgggtgcagcaaaccaccatggcacgtgtatacctatgtaacaaacttgtacattctgcacttgtatcccagaatttaaagtataattttaaaaaatatgacaataaaaataataaaaaaaagattgtgtgctggatatcatatgtgaaaaattataatttgaggcctagaaagatgctaccttcctacacagaagatttgtttgcttctgggttagagctaaaggagcattatcaatcccagaagaaccttaatccattcaggtatgaagatgattctatgatgatcttaaagcactacaagtcctagtctaggcatggttcactcttactcctagagaactaatatttgggattttagcccaaagcctgaagattttaccagcgtgtctccttggcaggccttggactctagtttttgtcttcctaagcatatggacctgttaaaatttctgctcagtttgtagcctttcagtagtctcttctggaattgaaaaatttccctaaggaaaaagcaaccaccaaatctcaaattacctctctgggttttcttcttcttcttctgtatttttgctacatatacttcttgctttgttaactctatgatgtctttcatcatatttttaaaaaacatattcagattatttggttgttctcagtatgagggatgactttcatgttatagtctgccattactggaatcattacttattctctttgctttatgctttcagccagagagtcggtaggaagtataattagctggtggatagactactcagaattttattcctgaggtgtatgatgttctgggggggccgtgatgtatctcaactgatttttatcattggaaattggagtataggaagatttcccaaaaagtctcctgagatccaaacataagtatccctgttacctttggatatcaacaatcttagttcctcttaaaaactgatattaattattttagacaatatagtaacccgtatattgattatcaatcaagtgtcaaaaaatacctgaaatgaccatgttgcagtctcagttttcaatttagtgaaacctttgttgagtgctatggcataagtcttcctttgtggggctctaagaccattatacaatcatagtccaaagatgtgaagatggcaagcaaacatttttcaagtgagtgatgaggtgtaattttcaagtgagtgatgaggtgtaatcctgagaggctgttctccatcctctatctcttggtttctagattagtgtgttctagccatgggacaaatgttaccaaattttaaatattatatttgtccataaagtaaagtttgtttagcatattgatcaaatctcttataatcctttttggtttttctgagttatgataaaatctccaactatgcttattgactttatttctctttgtatctgtcaactttatatctgttgttactatgttactaggtgcataatttttaaatgcgatattttggggcaacattaaccttttttcattataaagtgacctttctctctaagattgcattttgccttaaaaatgtctgaaattaatacagctataaaaattgtattttattagtgtttgcataatctaattttttatattcttttagtttacatattcttatattttgaatgcatctcttgtgaactgcttaaagttggattttttccattctggcaattgtcttattttgattaaaacatttagttcattataatttatataatcatttcatttagcctttatttctttatgcatctcacacttatctgagataaattatctgagatattatgtgggataataattagccttcaaaataaactatatccattatacactgatagataatagctagttggctagcttaatagatagttattagactttttagtgcttgattattggtggtaatttataattttctgtctaaaaactgtcattatcttgcctccattcttgaatgatatgttcactgggtatatcattctaggttgacagttattttccctcagtatatggatgaaatcatttcactattttctggcttccattgctgctataagccagctattaatctactcttttaaaagttatatgtctttttatcaggctacttttaaggttttctttctcaggtttctgtgatttcactataatgtatctagctgttgtttacttattctcttttatcattgggattttagagagaggaggggctttctaaaaccgtggattggtgtcttttgtcagttgtggaaatttctccactattatcgcctaaaatatttcctccacctaatgtgctttatcttctcctgctgggatttcaactagatataggtaagggctatttattgtatccattacatctcttattttcctctgtatttccagcttttcatatctacttgctgcattctgaataatttcttcttatctgtcttacaataattatttcttcagctacgtataatctactgtaaaagcatgcattgagtttttaatttagaaatgcatacataggtatctttaatttgcagatattttcaagttttttcttttattactgtatatatgataagtacaattatttaataatctatatctgacaactgagttttctaaagtttgtgtctttttctggtatttgctgtgttttgcttttgttttttgttgttattgatggtgtctggtttacttgtatgcccgattatctttattgtactggtaatgaaacctaggatcaatgtgattctctttacagaatattagctattgtatgggacaaccaggggactcttctaatatggaaccactttcgttaaagttgaagactggagatttcttagactaccctcactttactattacttgagctttgtgaaacgaaaataccttgggcccccacaatcactaagctaaaggggaaaacttcttagggcatacttgcctcacattctgttcaaagtcacccctctgctcactgagataaatgcatatctgattgcctcctttggagaggctaatcagaaattcaaaagaatacaacaatttgtgtcttatctacctatgagctggaaaccccctccccacttatagttgtcccgtctttccagactgaaccaatgttcatcttacatatgttgattgatgtttcatgtctccaaaaaatgtgtaaaaccaaactgtgctctgaccaccttgggcacatgtagtcaggacctcctgaggctgtgtcataggcacgggggtcctcaaacttggaaaaatgaactttctaaattaactgagacctgtctcagattttcaggttcacattttgataaccacaaagggagtctgagaggaggtgctcctgacctttgaaaaatcttctatctgtgcttggtatcagattgagctatgcttatggctcaaaccaataggacaatttgctgagacctggaagcacctcctccagagaatctctgatctgccaaaatttggttgagatctaaaatttattttgctgtacaactcctttttttggagttgtacacacttccaacaaacacaaggaagacaagtttttcctgcttccatgatgatggaaggcaggaaattcctttatggagtttgagctcacttccaacagggaaaaagagggttttttttttttttctgcttctagggtgttagagagcggtcttcagcctgagcctatccctaggcaagtaactaaattggagtatgtcttggctaaagttaagattaacaaccagctgatcttaatttctccttaccattagagtgctcagtaatcatataagttgtgcaattgtttattttgcttaactgttttttgctgttgtcattagttgtttctgtttttgttgttgtttcagtctttttcacattgggtttgatcagctctatgtgacttgatcaaatcccaaggaagttccaaattatggggaacaagacctcggaaggagttaaattcacacacacacacacacacacacacacacacacggtggtgtggtgcaaggagaaagacggccagcaaaaagacaaaaaaaagaggaaagattttttatttttattacaaaggggctttatttacataacaaggccacctttttcctagccaggccaaactgaaaaagcaatggctacccttctgaaatagcagcaatttgtcctagctgagatatggtaatgagatttaagaaggtatttttaaaaggaactcaatggtcaaaagtcagcttaattaaaagctaacatccaagatgtgtgtttgtgtgtgcccatatgtgtgtgtttgtatttaaaaggccttcatgtttttgtttttgtttttctcctaggaccttgtcttcttctgaagcaaaagctttttcttctcagttgactgaattctgttttcttcatttacttctgctttctcttctttctcttgcaccctctgctgcatggggacctaaaatactttataacagcctgggattctttaaagaaaatggagaagactgactccctttgggggagaaacctgtttttccttatggaaccccaagaatgtaaacagacaagttcgtctcagctcttaaactgcttacttttgtattgcattacctgtttatagttattgcaacagaggttactcttgggtctttaaggaagagtatggtttcgatacttagaaatgtctttgtttaaaaaaaaattaagtgtactgtaaaagcatcatgtgatctaacctcacaataattatccctttgtggagacccatgattcattgtaggctctgtccaaagctcagagatccagtcaaaagataggtagtccctatctaaataaaactggtctccttatacaatcctgtgatagatttctacaatttatgtttgatttggcatccatctttaatctccctctagcacaaacaggctttttctctctgtaccttatgatataaattttgctatttgatttttcacctgagttgtttgctttaatatgcaaatttaaggctatttagctgacaacttcctagggttgtgaaacaggttatcaagaatctgaaagtctaaaataggaaaataaaaggtttttataaaactataagatgtgcttctaccggcatgcctaatatgtctatgtatttatgtgttgcatacacaatgtttcactactgaaaatatataaaagactgctaattaattggcttaagaaaatagaaacatttgaatcaaatattttatcaggaaaaaataaaagactagtcaaatgctttttcaagtttacataacttaaaatctttattaaataagctagctttaaaattattggtaaagtaatattagaaatgtcttaagaatcaccagcacacatttatttgcatgtattaatcaagcaatttcatatttattcctgccaaatattataaggtgtcaaaatttggcataggggttacaaatctacaaacccagcacaagacagaatgacctttgcttgtataatctttaataaatcagacattgatgctggcttaataaaaatagttatgtcttgaatttagtaagattaccataacttctattcttgtggctttaggcagtctagtccacaggcattaaggtttgttttgggaaaggattgtcatcatctttgtttcaaagctaaactataaagtaagttcctcccaaacttagtttgtcctatgcccaggaatgaacaaggaaagcttggaagttaaaagcaagatggagtcaggtcaaatatttttcactggctcagttataattctgcagtggtggttccctaactttaaataacgaccatcatagtttttataaataatctaggtacatgattagaataaaataattagatatatattacaggataaatacttgtagacaaactcatcataatttagaatctaaagttatgttaaattaagtaatagatatattattatttgcgtattttccaagaaaaatatatttgtgagaaaacattctttctaaaataaaatggtattctttttaaaaagtgaacaatttttgcctaattcaaaagtttatttaagggtcatttttcaaacaaggtaaaaggagccaggaaataaaagagatgttaagaaagttatataaataaagagggttttttcttgtaagaaggctaaagagaaataatttcatatgagaaagaaccttgtatgataaatttagtactagaataaaatggctggttgttaaggacagagggatgttcagaaaaacaatttcaaggatgtcataaacggtctgtgtaagtcataagaaaaggatttatttttaaaaaacaacaaaaatttatatatgatcatgttgtctatgattaaagggaaattataatgatctttctagagattaggtttgatgtaaaaaaacacataaagaattggttagaacaatgaaattttcttaagggtttgatttactcttgataaattataagagattttaattttttttatttcaacccaaagttcaacttttattgcatctcactggtttcagtgttctctccccttttaaaaggcatgaaaaagtaacattccccttgaactcattttcagctcaaatatatgttttttttcctccttgggttctgttttttgtggcctgatgctaacagtagtttcctaaagagctaaaggaaatattttattccaaaataatattctgtgcactgcacagtgtcttttcttttgccttttgataactggcctaacagattttacattttatcaaaatagttcctatggcattattattaagtttggtttgcttaggagaaactgatattaaaaaaatattttttaaattaagtttattacattcttgcattttcctatatgtgctttgaaagttcttgtgacattgagttacagggctttatctcctgggtctaaaaagaacaccaagacctgctaaatcttaaaaactaacagcaattaaagcctcattttcagtcccagtagaagatgccaatcaaaataaactgccttcctgagacacagggcaaaaaattaaagctatttaactcctcaagggccagggatgatcatggaagacatgagcatgtgagattgtaagtacttattctgagagataaaataagttcagtttctctataaattaatcatgaatgtcaaaggcacattgatgcaacaccagcatacgggcccctgggtcagaataacagggttttcttgaaatatgaactgacctgttaataaaggttataaaggcttaagaaagttatatcttatgatcaagatgaaaatgttatagattacaaaattttggaaaacaaatttaattggcttcgtgctgttttttttagggcttattgtttgaaaaattatgtctcctctctcaaagaatgaaggtttttgccttttttttgaaattcttatcactttggttaaatgaacgacttattttacaatgacctgtgatcctgtttcataatatcaagtgttttaagcctttcatatttgacacactttccaaatcaaattgtaaattatgtctttttctgacctaattaacctttaagatattattaatagattccttaaacaccaaaaatgccattccttctgaaactattccaatcaacagaaaaagagggaatcctccctaactcattttatgaggccagcatcatcctgataccaaagcctggcagagacacaaccaacaaagagaattttagaccaatatccttgatgaacattgatgcaaaaatcctcaataaaatactggcaaaccaaatccaacagcacatcaaaaagcttatccaccataatcaagtgggcttcatccctgggatgcaaggctggttcaatataagcaaatcaataaatgtaatccagcatataaacagaaccaaagacaaaaaccacatgattatctcaatagatgcagaaaaggcctttgacaaaattcaacaacgcttcatgctaaaaactctcaataaattaggtattgatgggacgtatctcaaaataataacagctatctatgacaaacccacagccaatatcatatggaatgggcaaaaactggaagcattccctttgaaaaccggcacaagacagggatgccctctctcaccactcctattcaacatagtattggaagttctggccagggcaattaggcaggagaaggaaataaagggtattcagttaggaaaagaggaagtcaaattgtccctgtttgcagatgacatgattgtatatctagaaaaccccattgtctcagcccaaaatctccttaagctgataagcaacttcagcaaagtgtcaggatacaaaatcaatgtacaaaaatcacaagcattcttatacaccaacaacagacaaacagagagccaaatcatgagtgaactcccattcacaattgcttcaaagagaataaaatacctaagaatccaacttacaagggatgtgaaggacctcctcaaggagaactacaaaccactgctcaatgaaacaaaagaggatacaaacaaatggaagaacattccatgctcgtgggtaggaagaatcaatatcgtgaaaatggccatactgcccaaggtaatttatacattcaatgccatccccatcaagctaccaatgactttcttcacagaattgggaaaaactactttaaagttcatatggaaccaaaaaagagcccgcattgccaagtcaatcctaagccaaaagaacaaagctggaggcatcatgctacctgacttcaaactacactacaaggctacagtaaccaaaacagcatggtactggttccaaaacagagatatagatcaatggaacagaacagagacctcagaaataacgccacatatctacaactatctgatctttgacaaacctgacaaaaacaagcaatggggaaaggattccctatttgataaatggtgctgggaaaactggctagccatatggagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactactgttagagtgaacaggcaacccacaaaatgggagaaaattttcgcaacctactcatctgacaaagggctaatatccagaatctacaatgaactcaaatttacaagaaaaaaacaaacaactccatcagaaagtgggcaaaggacatgaacagacacttctcaaaagaagacatttatgcagccaaaaaacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaaaacttttacactgttggtgggactgtaaactagttcaaccattgtggaagtcggtgtggcgattcctttgggatctagaactagaaataccatttgacccagccatcccattactgggtatatacccaaaggattataaatcatgctgctataaagacacatgaacatgtatgtttattgcagcactattcacaatagcaaagacttggaaccaacccaaatgtccaacaatgatagaccggattaagaaaatgtggcacatatacaccatggaatactatgcagccataaaacatgatgagttcaggtcctttgtagggacatggatgaaattggaaatcatcattctcagtaaactatcgcaagaacaaaaaccaaacaccgcatattctcactcataggtgggaattgaacaatgagaacacatggacacaggaaggggaacatcacactctggggactgttgtggggtgaggggaggggggagggatagcattgggagatatacctaatgctagatgacgagttagtgggtgcagcgcaccagcatgtcacatgtatacctatgtaactaacctgcacattgtgcacatgtaccctaaaacttaaagtataataataaaaaaatgctaataaaaaaaaagaccaaaaacgacatatttggcttatatggtataaaaattgtacaggaagcattgtcaaatgtaaaattgtgtttggtttcctttgggctgcatttgtataaatgtgttattggtatgtgttccaaaactatgggaaacccctatatttctgatatgatttaatgtacactaccagcaacaattataattgttatgctaaattattgtgtgccacagaggtaataaatttccttgttaattgtgtctttgcttatggctgtcctaaaactttttgtcatccatggacaattgttgccttgttttggtcctctttagaaggtggttttataatcagctataaaactctaacaggtgattttgaatgcaggtttctgagaactttggagactgtgacatcagaatagaggaaaactttcaggactcatagagaactgacatgtttatgagtatcaagcagaagagaaattaactgcaattactagactaatagaagtatgaaataatctttctaactttttgctaaaagtgttgctgatcctttgtttttcttaaaagaaaacttttaagctatttaaagcttttaacagttgagtaaagtatattcttatggacaaaatttggagcatatttgtttctctctacctgatttctacagaatttggaaactgtgagtattcttaagttatgatgatatagtcatttgcataagtgcaataagaatctgttttcatttgtaacaggacacaattggagaaactggctattttaccaaggctttgactggaatggaatgctttcctttaaggaatcaaacttgacttacagagccaataaagccctttggaaaatctggccttatacctttgtctacacagtccctatacagggttcttgacctgtggtaagtaaacaatgccactttctgacaggcccaggagccccaaatttatcttggaacctcaagaggagaggaatttacccaactcataggtatttaatggtacaaatccatggctgggcttggctttaaaaaagtcttatctgagattccttctatgaaacaaattccatcaaagccaattaaaataaaaagcctatgtgaaaaagaattattcttgctgcactttatacaaataatctggccaagtacaataaagcaaattaatcctataataatttgtctttagtaaaaatgggaaaccggagagagaaaaaatatgtttcaaaaactatattacacctaccattaggctctagtcagtttttattattttctacactttggaccgaattctaatttttcttagctacaagccttgaaaataatgtttacattttatttccttcctttctcctcatttttcctaatgtggagtcaccaaaaactaagctgtgttttcttaaaaccctgggaactgaagccagacaacttaaacttcagaagaaaataacagcaacctatttacatacctaagccactttcatacctgcctactgatgtatggacttcagaggaatgtggtttatatcaatattccaggattatccttttgtttgttgttgtttttctcccttcctccccctattttctcttcataagacataagacgtcacagccttctaaaaatgagctttcctaataactcgggacctacctgtctaggaataaaccatcctaaccatgagagatcagacgaaacctgagaccagagactgactcattttcttctaaaatactttctccaaaagatcatttgaaagaaaaatggggaaatgtgaaaggaaaatatcttgggcccccaaattcactaagctaagggaaaagtcaagctaggaactgcttagggcaaacctgcctcccactgtattcaaagtcacccctctgctcactgagataaatgcatatctgattgcctcctttggagaggctagtcagaaactcaaaaggatgcaacaatttgtctcttatctacctatgacctggaagtcccctcccagttttgagttgtcccgcctttccagaccaaagcaatgttcatcttacatatgttgattgatgtctcatatctccctaaaatgtataaaaccaaactgtgctctgaccaccttaggcacatgctgtcaggacctcctgaggctgtgtcacaggcacgggtcctcaaccttggcaaaataaactttctaaattaactgagacctgtctcagctttttggagttcatagcttcaagaccaaaagaaggttgatttgttatgaatttatccttacccaaggctgtagtcctttgagagtaccaggcaattgtttggagaggactctaaaaaggagtttttactttgtccttattctgggatttgattcctatttctttcatcccaagagaccacaagacataataaaactcacacatttggggatctgaaacatcccccggtaaaaccagcttccatgattatttaacttctctgggatcccacttttaaaacctctgttctgctataatttcttcctattttactagttcttttgtttgtaataatttttataatttatttagcattttagttttctttaaaggggaagtatcaaccaactagcctagtctgccatcactggagctacaagtcccctttctttttctaagaagagaaaaatatgttatgtttttaaaattttatacaaaagataatattaatagcttacataacgtacaacctataacatgccagtaagtcagaattcttagagcctttaggaaaaacagtcattgttggtagctaagtcctggttctgggcatgatggcatcattaaggggtctggcttaaacaaatgtggacccagaggaggaaggatgggaagaataggggatatggtcaccaccagttgtgttatcgtgtagggacgggagtgtcgaagagctagttactattcaatgaagctgttgggagtctctggacataaagcagtacttggcacaagcacccctctccctttgccaatatgtaccaaataaggacaacttgcactactaacttgttggttgaatgaggcacatgcaatgctctgtggagcctgaggccaaaccacttggtttggcagttgaagtcaattattataaccctttaatacagccttttatctatagtaaagtggctttaaagttacatttaaaagctttgaacaggtttttgtgtggcagagcacactttgggcagaagctggggaaacactcgggggaatgcccaaggtaatacaagccatgacaattttgagttcagaacaaaggaagaggtaagaaagtcagtccttctgcggacactgttgagattggctttttaccttaattcccactgcagatgtgataacactgaggccaaatcaggggcagaaattttccaaagctacacagacaattggtaacaaaaaaacaaagtgaaggaatagaacatgccatcttcctttttagaccagggtcaatttccctgcacctcattgcttcaacaatatggacaaaagagcagtctgagaacagtgtcagtgggtaggaggtggggagagcattggacacccatgatgcaggatgggtcatgatggtggcttggcccagactgtgacttaatagagatggagaaaaatggatggatgtgagataagttttgtaggttgagccaactggacttgctgatggctgggagagggaaagggtatatcaagggtgactcttaggtttctgtttgcattcattgaaatgggaaagtgattcccaatatgcattataacttaaaatataggaaatgataatagtcacacagcacattggggtaaaaagaaataacaagttgaagatagaggcggctcactcaaaaacttcagaaacccaagattcttcctagctgttgcaagagctgcaaggaaaacattatcttggtacacttacaacccatttgagataaactggtattgagcacaccagttggaagcctctgagatgagtccacttgaagaaaactcagattggtgcaggagggtgagaagacgggggaagatatggaatcaagagtttgcttttggtgttgttgagtctgaagagctgtgagacattcaagatatgcagccagaggatatacgttgcctgttataagctttttggtcttgggaaagtgattttctttctctgggactcaggaactaaaagtccccagcttgtcagagaatgggaactttccattataagccagatcctgaagttcctgctagctaggacaacttattctcatgcagtctgtattccccaggtgaagtctatgattaagggcaggtccatacaaaccagtagttaaatgattttggaaagaggagctgttttaatccgtttgggattctataacaaaatactttagactgggtaatttataaacaataaaaatttattgcccagttttagaggctgggaagtccaagatcaaagcatcacctatttcagtgtctggtgaaggcccagtcctcatagatggtatgtgttgtgtccttacatggtgtaaggggcaaacaagctcccttgagcttcttttgtaaggataccaatcccaatcatgcgggctctatgcgcatgacttaatcttatctcccaaatatcttatctctctcttaagaacattgcactggggattaggtttcaacatgtgaatgtgggcgtgggggggacacaaacattcagatcatagcaggggccaaggtcacagagaaggtgaccatatttgtaataggtccagtaaacctatggagagattgctcaatggagcaacaaatggttcacttcccaggagaaggagactgtgaataagtattgaatttcaacaggcagaaaagagacaactctatcaggaggagtgcttgttcacctgaatagacaacgataagtgccatcaacaggagagtgagaatcaaggtagtgaaaaagaggtacattttttcttttctgtttttttttttttttttagatgacgcctagctgtcgccatgagtgcagtggcgtgatcttgtctcactgcaacctccacctcccgggttcaagtgattcttctgcctcagcctcctgagtagctgggactacaggcacacaccacctcgcctggctaatttttttttgtatttttagtagagacggggtttcaccatgttgaccaggctggtctcgaactcctgacgtcgtgatccacccgcctcggcctcccaaagtgctgggattacaggcgtgagccaccacacctggcccttttcttttttttaattttaagttcaggggtatatgtgcgggtttgttatcaatacatagataaacttgtgtcatgggggtttgttgtacagattatttgtcacccaagtattaagcctagtatccattagttgtttttcctgatcctctgcctcctcccaacctccaccctctcataggctctagtgtgtgttgctcccctctatgtgtccatgttttctcatcatttagctcccacttataagtgagggcatgcagtatttggttttctgttcctgtgttagtttgctaaggagtgggcatttttgagagtgtgcacctggcagtgtgaagtggtgacatatgaaaagagacctgaggtgagctgagaagggcaggtggctggggtgcagtgaataggggccagaccatgccaggctttacaggcttcagtgagggatgaagacttcattgtacctgtggttggaagccactggaaggtcttgagcagaggcatgacataatctgatttgattgacaggccactctggccactgtgaggtgattacattgaaggggggaaaggggagacccggggagggggccagcagcaagaaggctgacacctcccaagcctgccacaagccacgtggctctcacacctcccaaaccgaccacaaggcacatggctcacattacacattcaaactaggttggggcgagtgggtccacccaggtcctaggcttcatggtaacatgtccagggacttcagaggtgattctcatggccactttcctcctcttttccatctgtgctccccaaggttggatagcttaacaggaggcactgagcggatccttcccactggtgcaaccccctcctctatctctgttctgaggcctactcgcctacttgtatggtccactgtcctccgagggaaaggggtctaagaagagagaaatatattatgattttaaaattttatacaaaagataatattaatagcttacataacgtacaacctataacatgccagtaagtcagaattcttagagcctttaggaaaaaaagtcatcgttggtagctaagtcctggttctgggcatgatggcatcattaaggggtctggcttaaacaaatgtggacccagaggaggaaggatgggaagaataggggatatggtccctatggacctatggtccccaagaggtctcttgccctcaggagaaagccaaaagcccctgggcattgaccagctgcactcactctgagtgggctcatttgctgaactcgtgggaggaggacggactcactggcaggcccactgtggctgcctggctaaaccaaggcctcccattgagatgaaaagatatatatttcactagcttttgggggtacaagtggttttttgttacgtgggtgagattttatcagtaatggaactgttactttgatctccatctgtctgactcaggcctctgggattcagaactctgtaagggaagagagaggctatagatctggccctggggatcccaactctgagctagtgctgtgatctttattgtggccattatgtaccagcatcccagggataaggcgctgactggacatttctcttcaggcacatggaccagtgccagtaacaccacctgggagcttgtggaaatgcagtgtctctggctggacccagaccctctgagtcagaatctgtgttttaacgagatccttcgggggattcacaggcattttacagtgagagatgcaccataaatctagtgttttcccatcaagaatttggcaacataacttagctctttttggaaatcctgaaactactttgacattaatatctgggagtaaattgctggaaagggcaaatggcttgtgcagcataagctcccacctgagtttctgcttgagacaggtgcatgcatattcatctggcctcaggcacagattacgggctgttaggcaatgatggactgaggtaaatatgtttggtagttggcaaaaagcaagctggctcttccccaggtgagtgacctcatggtgccttgcctggttagtggcttttctatatgaagccttctatatgaagcctcctatgctactgtggttctggagcctgacttggcagctaccatatcacacataccattttctcagtctgcagggcagggaagtctccaagacttactaactgcagtcaccagaacagccagcacacggccaccagtgaaggctggaggaggaatgggaaatctaagtcatggaaaatctgagctcagaaactgggggcctgtcatacgtttccttgcattacctccctgggtagcttcttggtgctacccaagctgtggccacattagtgcaaatctctgtgagctaggggttattatcacagctgtttgctaatgagatgaggtgggctcaaagaggctaagaggccagatcgtggtttttcagctgatgagcggccaggactaagatggagaagtatctgactcaagctcttattctcttccccctgggtcatagtccaggccatttcccaccctgactttcattcacagaagactgcacttttcaaaacatgaacttcagcactctcaaggttgaaggaccttgagaatttaggttgcaaacttctttggggtgcattatgtccacactatggatattattaatgctttcctcagaagccccctctgctaaagagctcagattgatagagacctcttttaaatgatgctcatccctgcattttggattcccctagatacccacagcacagggccaggactatccatcccctgggcctccctgagagagaggcctgaggagtgcaattgctgcccacacaaggggaagacctgcttattcctttgtctggatgctctaattctagtaatgccacaaaaatcacaaaagacagtgttttccaacgctgcatcagttgcaatgaggtttgcaaaatatttctttatcttggcatactgcctatcaccagttctgactttcccaaaatgctttatttgtgtatggaataaagggggctggaggaagggctttcttctccatgtaaggtcactgccattaatcacctattgccttgttaattgcacattgtcaccttcacatcatcggtgcctcacagggattaaaaatccatccaacgctattaattggccttatttaataatgactcagtaaataagtatattgggcatgttgaactgtgattaacctactgttaattggccccctggcctggccaaggacaaaagtcccaacctgtccttggaaacttgccaatgcctcattccatgggacggccagaagccagggcctcctcaaatgtggaggccacaggcacagtctcagttccaactactgctggtggaagcagggcaggaggaatcctcagattccagccagtcaaggccccacattttctagatgaaaaattgagattctgacatgggatttacttattcagagcatgtgaacagtcaggcttccatgtctcaggaggtcagacagaaggtttgagagttcccccagcacattcaagggtagaggtaaagaaagctgggaggaatcagaatccaggccaaactgtgtcccaggtccctgggtctaagagactgatttcgggcagtggtccccaacctttgtggcaccagggccactttcatagaagacagtttttccactgacaaggtgggggatagttttgggatgatttaaacaaacacattacattcatcattagattctcataaagagcatacagcccagatccctcatatgcacagtccacagcgtggtttgtgctcctgtgagaatctaatgccgccgctgatctgacaggaggcggagctcagctttgcttgttgggctgacgctcacctcctgctgtgtgacccggttcctaacaagccagggacagctaccatttgtggcccagggtttggggacccctggattagggggtctgtgcctactaagcaaatcttacaaggcaaaaggtggcatcactctgtgtgtgcacctcaaaaaaaaaaaaaaggaagtttcactactttttcagcctataatcttcaagtcaggatttccaggcccatatattcaggcttgagggatcattccagactcaccaaggggggacatgggtgaagggtcatttgaaacttctaatcccctggtggtacacgttgacacattcctgcagctgcccacttgctctgacctatcatttctgagcagtcaaccctctattcactagaaacctgcaaaccttccccatgttaatcgcagtactattcacaatagccaagatatggaatcaacctaaatatccatctattgatgaatgaataaagaaaatgtgtatatgaatacacacatatatgtgtgtgtatatatatgggtatacatatatgtgtgtgtgtgtgtgtgtgtatatatatatatatatatatatatatatatatatatatatatacacacatacatgcagtggaatactacttggccataaaaagaataaaatcatgccatctgcagcaacacagatggaactggaggacattatgtcaagtgaaataagccaggcatagaaagataaataccacatgttctcacttgtatgtgggatctagaaagagttcagctcatagaactagagagtagaagaattgtggttattagagggtgggaagggtggggcaagggggaggatagggaaagtttggttaatggataagagattacagctaaataggaggaatgagttctgatgttctatagcactgtagggtgaatatgggtaacaataatttattgtatattatcaagaagatgaaagagaagattttgaatgttcccaacacaaacaagtggtaaatattagagggggtggatatgctaattaccctgatttgatcattacacattgtatacatgtatcaaaatatcaatctgtatcccataaatatttataattattacatatttccatttattaaaaataaaaggaaaaaatggcagattttcagaagaaagaaataaagaagaaatctcttcgctgaggaacccacttcttcaagaatctccctggtctttgctgtgtattcaggtcttagggaaagctcttcatattccttgcccatgagaatcatccctgtgcacagatgctctgctactcctggaaatagactaccaggtaaacttggtatcaccatgccatagtttccactttaccctaactgagcttttttctctctagggagtggggcttgttccatcagggtctctttcctatccttaacacaatttggaaacccacttgggcaacatctgtgacactacaggagatgccaaagtgaataagactagcttttgctcacagtctaagaatagagatagacaactggaaaatgtgctagatgaaggaggtaagcaaatggctaatgggagcagggaaaatgaggtattaattcctccaaggtgatcagtaaaagaggcataagggagctgactttcaagttggtccttgagtggtgagtgagaattcagatggggagatgagaatggcagctcaagtggatggaataacaagagcaaaggcatggtggcagacgagtgaaaggtacgctcagagtacagacagaagtcctgtatgtctggaacacaggatggaagtatgtggtaggggatgagactagtgggaggatagaactgagtgtttcctcttccggccctgcgttttggttagttattgctgctcagcaaactaccccaaaacgtggcggattaaaacagcaaccattttattacatctcacaattcagtgggttacgaattcaggcaagtctcagctgggtggttcctttgatcaacacagatcactcagtggtattcagctgacaaatgggctggtatggtaaccactccccccacgcccctgcaccaccctccagtttcactcacatgtctgatgctctggcaggaattcctagaaggctaggctcagttttacttgtcaaccagaatacctccacatggcctcaacagcatggtgatctcagggtggttggatttccttttttttttttttttttttttgagacagagtctcactctgtcgcccagggtggagtgcagtagcactatcttggctcactgcaacctctgcctcccgggttcaagcgattctcctgcctcagcctcccaagtagctggtttacaggtgcccaccaccacgcctagctaatttttgtattttttggtggagacgaggtttcaccgtgttggccaggctggtctcgaactcctgacctcaggtgattcacccacctccgcctgccaaaatgctgggattacaggcgtgagccactgtgcccagccacggctggatttcctatgtggcagctcagagctccaagggcttgtgttccagtgacccaaatggaaaatgcacagccttttataacccaacttctgaagccatacagtatcatttccccagtaggctattggttggagaaatcagaagcccactgaaattcaagggcttcaccccttgaatcacttcaccctttgacacacttcaccccaagtgagaggagtgttaaataatttgcagccgtgttttaaaacctccacacctgcctcaccagaatcagccagccatgaaagggtccaaggctttcctggttcttggctctttactttctggatcaaaaatctggtgagttgaaccagaagctgattcacttcaagaagtctgctcttagagagcagactaaaggaaccacaaagcatatctgcccccatccttaccatacctgtgcacatctcatttcctggtagccagaaaataaatgaaagtggtgattaaggcttacagcattcttcaagaaccgctggaaaggatacagggaggtgtcccaccataggggcaatgtcttgccctgtgaatctgacactgactctctgaagaatgttggacaagttcattttcctctctaggttttatttctttatctctgtagtggtgaggattcctactatacatttagagaagcaaatagaacctgcagtgtatgactcagagtgtgtaatattcatttaccgtgatacagaggctccagaggtatgacgcttgctcctgctcaaaatgctcataatttattacgctgtttgcattctcattgctaatttgtatggttttcctacctctcttttgctatctctccctccagtgcttgtcaatatgtctttcaggcttcctctgagaatactccttccctatagctctcttaaatgcaagctgaggttgtttattttctcacatctcatgtatctcagggtctaaaaatggcattggtgtcctttttgcttcagaacctgactcctccatctttttgtaaaacaaaacagaataataaagaaacgtccatttatttgagtcctatgtaatccaggtacaacacagtctctccttccttacttttctaacccacagatctttttctaatgtcctggccacaatactcccatttattgagtacttggcacctggctcacagtgttctgctgcaccttaagctctaccatcattttggatgacttcagcgtccacgtatgtggctaattcatccaacaccctaatttttcagttccttaattcccttacttccaaagaccctcttttcactttatctcagccacctactctcacagtcacattgtagaccttgttatttcctgttattgtccaacctccagaaccagtacttcaagcatcccactctttgacaacaaacttccctccttctgaattgcttgctctactcttcaccatgatcattcttcacaatgttgggactcacaaaccattgactcttttgttgttgccagtttgtcaacccttttctttctctgcctgacactttttcctatttggattgcttggctcatccgtttacaccattgccaatgccttgcctaaactctcttgcttctcaatgtttgtcattcaaactctgcgtgaactaaaaaatctgtttgctctgtgcctgagcctcagcagctgagtaatgctggcaaaaattgtagttaaagaaagttgattttggccaggctcggtggctcatgcctgtaatctcaacactctgagaggccgaggtgggtggatcacctgaggttaggcattcgagaccagcctgcccaacagggtgaaaccctgtctctactaaaaatacaaaaattagctgaacgtggtggctgtcgcctgtaatcccagctacttgggagactaagtcaggagaatcgcttgaacctgggaggcagaggtttcagtgagctgagattgcaccattgcactccagccagggcaacaagagtgaaactctgaaaaaaaaaagaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaggaaaggaaggaaggaaggaaagaaagaaagaaagatagatgatttcattcaaaatgcatgattattaacttcaaacggttctcccacgctgcctggcaattctccagcatacctctgatcaacttatcctctcattcatccacaacaattatttcataccttatctaccatcctgaaatctttaattctgtaccctaactccgtctcaccaacagcataggaacctcactccctagtttatgcacataaagtagaaatcatcagaaagaaatttccttgtgttgtagatatcaaacctataaaactacctatgtcagcacccatctttacttgttcccttcgtgtatgttagaggaagtgaccatcttttttcttggtggaatccctcccaccttgtcttggatcatacttggtctcaatttctcatagtcctgcccatatcaattaccacttctcttccttgtatgtttaattgctacctcttcttgggaatttgagtagtgtgtaaactagcttttactggaaacaaattcagggcattgctagagcatagtggttttagaaaagtagcctccaatgtgagttgcatgggagtgatttatcgtggtctgataaagaagacattacagtttgtttctttgtctttaaatttacaaaatgggacagaaacttacctttttaataggtagcatacatgttgatatattgtcctgtctcattttgcccaactgcgtgacatacagtcctgagtcttatgctatgtgagaggtaccctaagataagaaggaagatgaacaatgttctagcattgacatagggccatcatgactgtgtgtcagcattttgagcaggtcatgggtgctgagttaaatggatttacagaccaattctttttcatgacagctttattgaaatataattcactgatcataaaattcatccctttaatgtatagaatttagtggttcttaatgtattcacagagctgtgctaccatcactactatttaatcccagaacattttcatcaccccaaaaagagacactgtgcccattagcagtcacttcccatttccacccaactgtcctcccatccttaggcaatcactaaactattccctttctgtatggatttacttattttgagcatttaatagaaacagaatcatacaatatgtggtctttctttcccttagcaccatgttttcaaggagtatccatattgtaacatgaatcagtaacacattcatttttatggctgggtaatattcctttgtatagatatatcacattttgtttatctattcatcagctgattaacatttgggctattttcaccattttgcagttatgagtggcactgttatgaacattaacgtacaagttcctgtgtggacatatgttttcatttctcttgggtagatacctgggagtgcgattgctgggtcatatggcaaaactatatctacccctttgattaaccatcaaactatttcccaaagcaactgcaccattttataatcccaccagcaatgtatgagagttcaaatttcttcacatttttgccaacatacagaatgagagaaaatatttgcaaattatatatctgataaggacgtgtattagaatataaaataaactcttagaattcaaaaaagataaattaccttgctaaaaaatgattgagggatctgagtagatatttctccaaagacaatatacaagtgggcagaaaactgtaaaaagatgctcaatattcttttatagggaaatgtcaatcaaaatcacaatgagataccaagtcacactcattagaatggctaaaataaaaaacttgcccacttttaactcaattcaccctcacaaagtagataagtacctttaaaagtttcttgcaaagaaacagcagattgaagataacaccaacaatgctagcataaatgaatgacaagaaaatgacacggcagacccttcaaccaacctaggaacaaaccttttatacatgacaaggtaatcagatgtgacaaaaatttgtaaaacgttgaaattttcaagataatatgaaacgtaacatttcatcactattgttaatgatgaaccttgcatgaagtgtatatcatgccttgagaaattagcagattgcagggtaaagccatcagaatttgtaagatatttataggtattatttagctcatctttatattatcctttttagaattcaaaaaggatataaataaatattcatgtatttgtgatagatgaccaaaaacatttaactgatgggatgggcaatgacaaaaatatgaagattactgtttgacagtgcagacttgaacttaggtcctgcctgaaaccattactaactggttgactttgaacaagttacttagctacatacttggttcctcatctgaagaaatgggaatattgatacagccacctcatggagttattacaagggttaaatggtataatgtacatgaaacaggacagtgactgcatgtagtacacgctcaattaatatcacagtggtgaaaatgatgatgaattcttgacagggttgggggtagcagagagggattttaatccaacacaattacactctagaattaatatgaaacctgactctcatgtggccccaaggaatgtacagtatcattgccatcctcagcctatattcctgtttgctactttgttgtcttctctaaagttcttccttctctctccaaggttccccatcagttctagagtttctaaacttcattttttctggctcaccagaggacagggaaacacctgttacttcatcatgccaagaattttaattcttgttgatctcacctcttccacctcctctgtgctcactggctctgcttttcatggccatgtggccctaataagattattttagacagaaaggatctttttttctaataaaattcagctttcctccagggccaacacaaaaccacagccagctcttaaaataacaattgttttcctcccaccacaaatgaaaaaaatgaataattgaatgaacgagttctctctcctgttgaaagaactcagggccttctgtccaatcaaataagcagcctcactctgttacctcccgcgttccctaggagctgcccttcattctgccactccaggctaattggacttccttagactcttgtcatgtcactcagggcatttgcgctagtggtggggttggcagagaagctgaggggaggtagcaatagagattgtccatttcagaggagaaagtagctggatgtagcaacatgagctgtagttaacttttctgggttttagtttttgtctgtaaaacaaggagatagaactagattagagaggggaccttgtaaaccatacatgggagtgctttaaatccccttagtattgagagacaggaaaagaactaaacactactgaatctgattatctaagaataaactagacacaggaaggttttgccacttaaaattggccacccacagtggttatccttagatggagagattagctgttattttcatcttttacatttttatactttccaagacttaaataattgtcaaatgctgattttccaatcagttatcatataatgtcaagtaaaaaactcaggatgcaacctcgtaaatacagtctgatctcacatttgcataaacatttttatgtgtatatacaaaatgccttgcaacagtgtttttatctgagtgatgagattgcagtgattttatttttctctatatgttttgatatgttgtaaattttatacaataagcacaatttttttaaccagagaaactgagaatatttaaaaattaaatttaaaaggccctgttttgctaccaaaatggtagcaaaatggactccagccttgcccccaccctcttctcagcaattaactcagatccagtgtcttcctttgtaaggtttgatttcgatgatattttccccctcacccctgggaccaatggagactgccaggcatatgttttgctacatgtttatagtgtcttggagaagtcccatgagtgcacatacacacctcttactgccttttttaaagcttacccgggtacaccacagggcaagctgatgcctcagggaaaagctgctctttgctgcagacttgatgggccaggattcagccattctggtcatagggccagccctgaggccatcaccagccattcaagtgtgcttctgcctggcaaggctctacctctgccaattctgtagcagctgtagcaccaagggaggcagacatcctaacactcacataatgctagccactcaacaacaccttctgagtgggtgctaagttacctacaggaaccctacaaaactgtagaaggaaggtctcagatcttggtacagtacttaatgtcatgaaatccctcatcttttcctcctttggcactctgagctgatgctaaagccgatgcaaccttatagaaagcttggaatgccactatgggcctcaaatgactctggttcgcaggtagcctgcaacattacttgtgcctggcttcactctcataaatagtgactatacttcctgcttcactcagaaaaatagaagtaatcagaagagaatttctatatactaccctcattatatctactccctacaactgtacctatatattctgtcttatgcctattactataaactaactccccatgattatacctaaaatctatctttgttcttccacagtagatcaatttctctctctctctctttctctctctctctccattggaactgctcttgaagaggtcaataatgacctttatataactataactattaagtctcagtatttatcctacatgacctatcaaaaagcatctgtcactgtcaatcatagcctccttcttgaaatactttcgtaacttggtttccaagttaacatgcaatcttggttttcctactactgcagtgatggctcaggttccttttcttattcttactctttggcatgaacttttcttgttggggcaatccagaaaacactgacccacttctgtctatgctcatttccattctcttggttttaaatatctgtataccactaactttcgtatttgtatttttagttcagtcttctcttacaaacgacacactcatatatacaaattccattcaacatctacacttgggagtttaatagacaatccaaactaaatatgttcaaagctgaacttctgattaactctcaaaatttgctccatccacagccctccctatgttagttgatgggaatttcaaactccaagttgctcaagccaacgaccttagcattattcttgctctttggctttcaatagaatctatcaagaaatgctattgcaaacgactttaaaatatatccagaatccagtgatttcttaacatctatattgctagcatcctggaccaaaccatcatcatccctccttactgttctctctgatgccactctgccctcctatagtccatgatagtagccagaatgatcttttgaaaccctaagttgtagctttcagttgttatagagtaactggtactagacaagcagttcagttactaacaaccataaaactgtacaaaatatataagacaactgttttcaggcattagaaaacaggaagtacatgtctctgactaagaaagcacacaaggtatacctcagattcacttccttgagtgaggcctactttaaccccaccaaaaccagctctcacactaagccttgatgaattctggagggtagaaagtgtttgaaaactgagttctaagtgagatgggcatgtgaaacacctttggctttcacagatccccctaaacacagaataaagccgagccaaataagttcaaggcgaccaagcagatcacacagaacaaaaattgactctcttcagagaaacataacagaatttagagactcaaaaatgtatcattcacaatgcttattatacaatcaaaatttactagatataaaaagtaaatgggaaaatatgacccataatcaagaaaaaagcaatcaatacaaaatgatcagacagttcagaaattggatttagcagatagcattaaagcagtaattaaaaatctattcaaagaactaaagaaaaggaggtcttaagcagtgaacaaatagaaaatatcagcataaaaataagaaaaagaaataaaagaaaattctagaactgaaaagtacaatgattgaaatatataatatataggtaaagaatctctaatcaaaaaatccaaaatccaaaatgctccaaaatccaaaacactttcagcgccaacatgatgctcaaaattcagatttaggattttcctattagggatgctcaactgagaagaataatgcaaatatttcaacattttttttaaaaagtcaaaatccaaaacacttctagtcccaagcatttcaaataaaaaatacaaaatctatattacatataatatataaagtataaatttactttaattttttatttatacaaacttatggggtacatgtgaaatattattacatgtatataatgcataatgataaatcagggtatttagggtttccattagccaatacaatacatttttgttaagcatagtcaccctactttgctatctaacattgaattttttccttctatctttatctttctaccctttaaacccactactcttcatccttcccctacccacccttcccagtctctgttttctacctttccactctctacctccatgccattaagcttttcagttctcacatattaagtggaaacatgaaatatttgtctttctgtgcttagcttattgcacttaagataatgacctccagttccatctacattgctgcgaatggtgaactttcattctttatatggccaatagtattccattatgtatatgtaccacattttctttatccattcattcattgatggacacatgggttgattttgtatcttttttattgtaaatagtgctgcaataaacatgtgagtgcaggtatcccttgatataatgatttattttctttggggtagatacctaatggtgggattgctggatccaataataattttactttcagttctttgagaaaaaaaaaaaagcttctgtaccacaaaagaaatattccactaccaggtatctagaagttgtactaatttacattctcaccaacagtatataagcattcccttttcttcatgaccttgccaacatgttattttttgtaattttaatagtagccattgtgactgtggtaagatgatatctcattgtggttttgattttcatttctatgatgattagtgatgttgagcactttttaatatacttgttgatcattacatgtattcttttaagaaatgcctattcatgtcctttgtccactacttattggaattatttgtttttattccatttaagtatttgagttccttgtatattcaggatatgagtcttttgcgagatgaatagtttgcaaatgttttctttcattcaacaagttgtctctttattgactatttcttttttggtacagaagctatttagtttatttaagtcacatttgtctatttttgttttgttgcctgtgcttttgaggtcttagtcacaaattcattgcctagaccaatgtccaggaaagcttttcctaagtttttttctagtatttttatagtttcaggtcttatgtttaggtctttaagcccttttgtgttgatttttatatatagtgagagatgagagccctgtttcaatctgcttgtgactatcaaatttttcccagcaccatttactaaaaaaagtgtcctttccccagtgtaagttcttgtcagctttgctgaagatcattttgctataaatatgtgtctttacttctggattctctattttgttttgttgatctattttataccaatgccatgctatttaggttactatatccttgtaatatattttaaagtcaggtaatgtgatgcctccaggtttgttcattttgtttagagttgctttggctatttggacttttttgtagatatgcggcattatttctgagggctctattctgttccattggtctatatctctgttttggtaccagtaccatgctgttttggttactgtagccttgtagtatagtttgaagtcaggtagcgtgatgcctccagctttgttcttttggcttaggattgacttggcaatgcgggctctcttttggttccatatgaactttaaagtagttgtttccaattctgtgaagaaagtcattggtagcttgatggggatggcattgaatctataaattaccttgggcagtatggccattttcacgatattgattattcctacccatgagcatggaatgttcttccatttgtttgtatcctcttttatttcattgagcagtggtttgtagttctccttgaagaggtccttcacgccccttgtaagttggattcctaggtattttattctctttgaagcaattgtgaatgggagttcactcgtgatttggctctctgtttgtctgttattggtgtataagaatgcttgtgatttttgcacattgattttgtatcctgacactttgctgaagttgcttatcagcttaaggagattttgggctgagacgatggggttttctagatatacaatcatgtcatctgcaaacagggacaatttgacttcctcttttcctacttgaataccctttatttccttctcttgcctgattgccctggccagaacttccaacactatgttgaataggagtggtgagagagggcatccctgtcttgggccggttttcaaagggaatgcttccagtttttacccattccgtatgatattggctgtgggtttgtcatagacagctcttattattttgagatacgtcccatcaatacctaatttattgagagttttagcatgaagcgttgttgaattttgtcaaaggcctttcctgcatctattaagataatcatatggtttttgtcgttggttctgtttatatgctggattatgtttattgatttgcgtatgttgaaccagccttgcatcccagggatgaagcccacttgatcatggtggataagctttttgatgtgctgctggattcggtttgccagtattttattgaggatttttgcatcaatgttcatcagggatattggtctaaaattctcttttttggttgtgtctctgccaggctttggtatcaggatgatgctggcctcataaaatgagttagggaggattccctctttttctattgattggaatagtttcaaaaggaatggtaccagctcctccttctacctctggtagaatttggctgtgaatccatctggttctggactttttttggttggtaagctattaattattgcctcaatttcagagcctgttattggtctattcagagattcaacttcttcctagtttagtcttgggagggtgtatgtgtccaggaatttatccatttcttctagattttctagtttatttgcatagaggtgtttatagtattctttgatggtagtttttatttctgtgggattggtggtgatatcccctttatcattttttattgcgtctatttgattcttctgtcttttcttctttattagtcttgctagcggtctatcaattttgttgatcttttcaaaaaacagctcctggattcactgattttttgaagggttttttgtgtctctatttccttcagttctgctctgatcttagttatttcttgctttctgctagcttttgaatgtgtttgctcttgcttctctagttcttttaattgtgatgttagggtatcaattttagatctttcctgctttctcctgtgggcatttagtgctataaatttccctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtagttgagcgattttgagtgagtttcttaatcctgagttctagcttgattgcactgtggtctgagagacagtttgttataatttctgttcttttacgtttgctgaggagtgctttacttccaactatgtggtcaattttggaataggtgtggtgctgaaaagaatgtatattctgttgatttggggtagagagttctgtagatgtctattaggtctgcttggtgcagagctgagttcaattcctggatatccttgctaactttctgtctcattgatctgtctaatgttgacagtggggtgttaaagtctcccattactattgtttgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattttcttggtagatcttcctccatccctttattttgagcctatgtgtgtctctgcacatgagatgggtttcctgaatacagcacactgatgggtcttgactctttatccaatttgccagtctgtgtcttttcactggagcatttagcccatttacatttaaggttaatattgttatgtgtgaatttgatcctgtcattatgatgttagctggtgattttgctcgttagttgatgcagtttcttcctagcctcgatggtctttacaatttggcatatttttgcagtggctggtaccggttgttcctttccatgtttagtgcttccttcaggagctcttttagggcaggcctggtggtgacaaaatctctcagcattggcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgcttttctcgaggagtatctttgtggcattctctgtatttcctgaatttgaatgttggcctgccttgctagattggggaagttctcctggataatatcctgcagagtgtttcccaacttggttccgttctccccgtcactttcaggtacaccaatcagatgtagatttggtcttttcacatagtcccatatttcttggaggctttgttcatttctttttattcttttttctctaaacttctcttctcacttcatttcattcatttcctcttccatcactgataccctttcttccagttgatcgaatcagctactgaagcttgtgcatttgtcatgtagttctcgtgccttggttttcagctccatcgggtcctttaaggaattctctgcattgcttattctagttagccattcctctaattttgtttcaaggttttaacttctttgccatgagttcgaacttcctcctttagctcggagtagtttgatcttctgaagccttcctctctcaacttgtcaaagtcattctctgtccacctttgttccattgctggtggggagctgcattcctttggaggaggagaggtgctctgatttttggagtttccacttgttctgctctgttttttccccatctttgtggttttatctacctttggtctttgatgatggtgatgtacagatggggttttggtgtggatgtcctttctgtttgttagttttccttctaacagtcaggaccctcagctgcaggtctgttggagtttgctggaggtccactccagaccctgtttgcctgggtatcagcagtggaggctgcagaaaagcagatattcatgagcagcaaatgttgctacttgatcgttcctctggaagttttgtctcagaggagtacccagccctgtgaggtgtcagtctgcccctactggggggtgcctcccagttaggctactcgggggtcagggtcccacttgaggacgcagtctgtccattctcagatctccagctgcgtgctgggagaaccactactctcttcatagctgtcagacagggacatttaagtctgcagaggattctgctgccttttgtttggctattccctgcccccagaggtggagtctacagaggcaggcaggcctccttgagctgcagtgggctccacccagttcgagcttccaggccgctttgtttacctactcaagcctcagcaatggcgggtgcccctcccccagcctcgctgccgccttgcagtttgatctcagactgctgtgctagcaatgagcgaggctccgtgggtgtaggaccctccaagccaggtgcaggatataatctccgggtgtgccgtttgctaagaccattggaaaagcgcagtatttgggtgggtgtgacccgattttccaggtgccgtctgtcacccctttctttgactaggaaagggaattccctgaccccttgcacttcccgggtgaggcgatgcctcaccctgcttcggctcatgctcggtgcactgcacccactgtcctgcacccactttccgacactccccagtgagatgagcccggtgcctcagttggaaatgcagaaatcacccgtcttctgcgtcgctcatgctgggagctctagactggagctgttcctattcggccatcttggctccacccgagagtttttgtcataaagtgatgatgaattttatcacgagctttttcttcacctgttgagatgataatgtactttttgtccttcatttggttgatgtgatgtagcacatttattgatttgcatattttggaccatccttgcatccctgatattaatctcacttgactgtggtatattacctttttgacatattgttgtattcagtttgttaatattttgttgaggatgtttgcatctatgttaattagggaaattagcctatagttttctttttccattgtgtccttgtctggttttggtatcggtgtgatgttggcctttcttcaagaatgagttagaaataattccctcctctttgattttttgaaatagtttcaagaggattggtatagttcttctttgtatgtttagtaaagtttggcttgaaatccatctgatcctgggcttttatttcttgggagatgttttattactgattcagtcttgctacttgttactggtgtattcaggttttatatttcttcctaattcagtcttggtaagttttacgtttccaggaatttatccatttcctctaggttttccagtttgtttgtatgtagacatgcatgatagtctctgatgatacttttgcgtttctgaagtatcagttataatatctccttttttatttatgatttttcttatttgggtcttctcttttcttttcgtggctagtctagctagtgatttatcaattttatctttttgaagaatcaacttttatgtcatgtatcattagtattgttttttagtctctatttcatttagttttgctctgatttttgttatttcttttcttctgctgatttgcggtattgtttgttcttgctttgcgacttccttaaggtacattgttagattgttgatttgtaatctttctacctttttgatataggcatgtattgttataaatgtccttcttagcacagcttttctgtttcctacaggttttgatattttatatttccattttcatttgtttttgtatttttgtatttccattttcatttgtttcaagaaatgcttgattttcatcttagtatcttcattgatccagtgatcattcaggagcatttaatttccatgtatttgtatagttcttcttggtattggtttcttgttttattccattgtggcccgaaaagatacttgatataattttgatttttaaaaatatgttgagaaatgtttggtggttcaacatatggtctataatggagaacgttccatgtgctgatgcaaagaatgtatactctgtagttgttgaataaaatgttctgtaaatacctgttatgtccatttggtctaaagtccagcctaaaacttattttaaaaatgtattttctgtctagatgatacgtctaatgctgcagatggggaggagggaccccattctctacacatgagcccaagcacagaagctgttctacctgtggaagaggattttgctctccttgcaaagctgaccacagtgtttgttccactgctggggcaggatcacttctcaagcccctcaacaaggagctctcagggtgtgaaaagttaatgctttggattcttttgtcccaggggctccctttttgttgcactgcagtctcctttccccagggagtaatattccttgtgggctagagtactggggactccacagaacttttgggtccagctagcagtgtgccactgcagcccttcaggtggataatagaggatgttagtggttagagtttaacacaattgaaaaattcaaagtaagactaatcaaggaaaaagagaaaatataaaattttaataataataatgaaagagaggttatcaccaaaatttcaacatattttaaaagggtaataagcaaatattataaacaaatttatgccaattaattttataatatagatcaaatggacacatttctggaaaacaaaatttaccaaaactgacttaagaaggtatatacaatcttaacaacacatgtctcctagacaattttaatgtatatatttttaaaaactgcccacaaattaatatacaggcttaaataattttgatggtgtattctttcaaactctagataagaaataaaaccaatcatatacaaatcatttcagaaaacaggaggtggaacacttcctaagtcattttataaggccaataaaatttttttaagaaataaaaaatataacattcttcatgattatgagtgcaaaaaatcctcaataaaatactagcaaattgaatccaacaatatattaaatgttaagacaccatgcccaagtaaagtttataatatgaatgcaaggctgatttaacattcaaaaagcaatcattgtattttaccaagttaaaagaataaagaagaaaaatcatgtgattatctcaatagaattttaagaagcatttgacaaaaatcagcattcattcattacaaatgcttccaggaaacaaagaatagacagaaacattctcaatctgataaaacatacgaatattttccccctaagatcaggaacaaggcaaggatattcactcgtaccatttccactcaatattgtactggaggtcatagccagaggaataaaacaagaagaaattaaaagcgtacaggctagaaaggaaaatgaaaaattgtctttattcacagagaatataactccacaaagaaaattctaagaagaattcaaagaaaattctctccctttctcttaacacacacacacacacacacacacacacacacacacgtcctaacggaatttgtaaataggtaaatttaacaaaatgccggggactgttgtggggtggggggaggggggagggatagcattgggagatatacctaatgctagatgacgagttagtgggtgcagtgcaccagaatggcacatgtatacatatgtaactaacctgcacattgtgcacatgtaccctaaaacttaaagtataataataataaattaaaaaaaaatgccatgatacaaggtcaatatgcaaatagcaattatatttctatattccagcaataaacaattggaaataaataacaaatgtctttaacaatagcatcacaatataaaccacctaggagtaaatgtaataaaagttatgataaacccccacactaaatacatttctaagagaaatttaagattaaatacagagaaatagtgtactcctggaatggaaatacaatattgttaatatgtccattcccccaaattgatctctacatttaatgcaattccaatcaaaattatactaggaaaaaaaaaacagaaatccgttccaaaatcttcatggaaatgcaaaggtattagaatatcggggggaaattcagccagatatcaggtgaaattcacccccgatatttcacgtaggttcttttctattttccctaagtgtcagctggtctgagaaataaagggacagagtacaaaagagagaaattttaaagctgggtgtccgggggagacatcccatgtcggcaggttccatgatgccccctgagccgtaaaaccagcaagtttttattagtgattttcaaaaggggagggagtgtacgaatagggtgtgggtcacagagatcacatgcttcacaaggtaatagaatatcacaaggcaaatggaggcagggcgagatcacaggaccacaggactggggcgaaattaaaatcgctaatgaagtttcggcacacattgtcattgataacaccttatcaggagacagggtttgaaagcagacaaccaaatctgaccaaaatttattaggcgggaatttcctcgtcttaataagcctgggagtgctatgggagactggggcttatttcatccctacagtttcaaccatagaagacagctgccaccaaagcggccatttcagaggcttcccctcagggatgcattctctttctcagggatgttccttgctgagaaaaagaattcagtgatatttctcccatttgctttggaaagatgagaaatatggctctgttccgctcggctcatcagcggtcagagtttaaggttatctcttttgttccctgaacattgctgttatcctgttcttttttcaaggtgcccatatttcatattgttcaaacacacatgctctacaaacaatttgtgcagttaatgcaatcatcgcagggtcctgaggtgacatacagcctcctcagcttatgaaaatgaccggattaagagattaaagtaaagacaggcataggaaatcacaagggtagtgactggggaagtgataaatgtccatgaaatcttcacagtttatgttcagagattgcagtaaagacaggcataagcaattataaaagtattaatttggggatctaataaatgtccatgaaatctgcaaaatttatgttcttccgccatggcttcagctggtccctctgtttggggtccctgacttcccgcaacgctagaatagttaaaaccatttgtaaaagtagaacagagtaaaggacttccactacctgattttgagattgaaaataaagttacagcaaagcagcagtgtggtattggtgtaatacttagacataaaaatcactggaacagaaaagacagttcagaaagaaacctgtgcatacaaaatttaattgacattagaccaatgtcttagtccatttgggctgctataacaaaatgccataaacaaagtagtttataagaaacagaagtttatttcttatgggaggctgagaagtccaagaacatggagcaggtaggttcagtgtctggtgagggcctgttcctcatagatgccaccttcttgctgcatccttacatggtagaaggggcaaggcagttctctggaacctcttttatagggacactaatcccactcatgcgggcttcatgctcatgatctaatcacttcccaagtgccccaccacctaatacctccttgaaggttaggcatcaacacattagttttgggaagcatacaaacattcagaccattacaaacaaggtgtaaagtcaattcaatgatgaaagaaagtctttttaataaatggtactatgaaaactggatatctgtggggggtggggaaatgaatcctaatccttacttcacaccatatacaacattttaatttaaaattgagcataaacctaaatgtagaagctaaaactaaaaaaatttttagatagaaatggagaaaattcccataatcttggggtagacaaatatttattcaccagggcataaaaatcactaaccataaaaggagaaaaatgataaattgtgctttcttaaaatcaaaagcccccacaaagaagaataaagttggaggtcctatactactagatttcaagatctactttttaatcaagacagtgtagaaatgccataaggatagacacacagatcagtgaaacagaattgagaagccagaaatagacacatgcacagtcatttgattttcgcaaaggtttccaagcaatacaaggggcaacaaaaaaacgtttgaacatatggtgctggaacaactggttagctatattgaaaaacacacacctccaatctaccacacaccataaagattaattcaagataaatcacatacctaaatgtaaaaacttacaatcctaaatctttttaagaaaaatgaagaatgtctttgagaactggaggtaagcaaaggtttcttaagccacagaaagcactaatcataaataaaaaacaaagtgaacttaaaatcaaaatttctgtttcataagacacttatttctgctcataattaataaaatgaatggcaaatcataggttggaagaaagtattcccaacacatatcttacaaaatactgtttttcagaatatatatatatgcgctctcctgcagctcagtaagaaaaagacaaaataaaaacactttaaaagttggcaaaatatgtgaacaaaccattcacaagaggccgagcatgatggctcatgcctgtaatcccatcactttgggaggccaaggtaagagcatggcttgagttcaggagtttgataccagtctgggcaacataatgagacctcatttctactaaaattaaaaaaaaattagccagtcattgtggcatgtgcctatagtcccagctacttgggggactgaggtgggagaattgcttgagcctaggaggtcaaggcagcagtcagccctaatcatgccactgtactccagcctaggtgacagagtgagaccctgtctcaaaaaaacaaaaattcacaagagaaatatataaatggctaaaaacatatgaaaaagtattcaacatcagtagctatcaggagaatgcaaaattaaaccaaaaggaaatacctctgcacacacatcggaatggctaaaattttaaaagactagggctaaactagtgctattacacattgttggttaaaacataaaatgttacaagcactttgggacaggtctagaagtttctgataactaaacattttcctaccatatgacccagccattctactaagtatttatccaagagaaatgaaaaaataaaatgtgttcataaaaagacttgtagaagaatgttcataacagctttattcataatagccaaacattaggaaaaaaaaaaaagtccttcaatacaggggtccccattacagggtaccagtctgtgacctttaaggaactaggccgcacagcagcaggtgagtggtaggccagctagcttcatctgtaattacagccactccctcatcactcacattactgcctgagctccacctctcctgttagatgtcagatcagtggtggcattagattcttctttttttttctcactctgtcgcctgggcttgagtgcagtggtatgatcttggctcactgcaacctccacctcccgggttcaagcgattctcctggctcagcctccctcgtagctgggattacaggtgcacaccaccacacctggccaatttttgtatttttagtagagacagggtttcaacatgttggccaggctggtcttgaactcctgacctcaagtgaactgcccaccttggtctcccaaagtgctggggttacaagcatgagccactgcacctgtgggcattagcttcttagaggagtggaaccctgttgtgaactgcacgtgcaaggaatctaggttgtgcactccttatgagaataaaatgcctgatgatctgaggtggaccagtttcatcccaaaaccattccccactgtctgtggaaaaactgtcttctatgaaactggtctgaggtgccaaaaaggttgggaacttctgcttcagcagaagaacagataaacaaaatatggtatattcatacaatggaaaccactcagcattaaaaaggaagacattattgatatacacaaaaacattaattcatctctcaaactctcaaaaatagagcaaagaagagcaatctgaaactgagtaaaagaaggcatagacaagagagtacatactgtgtgtcttcatttatatgaagttctagaacaagcaaagtaatccttaaaaatgctagaacaggcggggcacggtggctcaagccaaagtgatcccagcactttgggaggccaaagcaggcagatcacgaggtcaggagatcaagaccatcctggctaacacggtgaaactccgtctctactaaaatataaaaaattagccgggtgtggtggcgggtgcctgtagtcccagctactcgggaggctgaggcaggagaatggcatgaacctgggaggcagagcttgcagtgagcagagatagcgccactgcactccagcctgggcgatagagcaagactctgtctcaaaaaaaaaaaaagaaaaaagtgctagaacaatggttgcttccagagactagtatagacagaggtatagacagagtttgactgagaggatcatgaggtaatagtacatggttatggtaacgttctacatctttccaagggcatggcttactcaggtttggaatttgtcacaactcaagggatatactttttagatttgtgcatttcattgcatgtacattttaaattaaaagaaaaaatggcagacaaatattgaattctagttgataacatatctaactaaatatttataaggaaaataacttatatctgtaattagtttgaaaatacacacataagattagatatttgatgggggatggataagtgtgatatagcaaatatgtagaacaatggtagtatcggccaggtgcggtgtctcacgcctgtaatcccagcacattgggaggccaaggcgggcagatcatgaggtcaggagtttgagaacagcctagccaatatagtgaaaccccgtctctactaaacatacaaaaattagccaggcgtggtggcacgtgcctgtagtcccagctacttgagaggctgaggcaggagaattgcttgaacctgggaggcagaggttgcagtgagccgagatcatgccactgcactccagcctgggcaacagagcaagattccatctcaaaacaaacaaacaaacaaacaaacaatgatagtatctagatagtagtatacaagtgcttactttgttatgtgtgtcaacggttttataataatatgttgaaaaaaaaataaatctgttcttccaaagacagaaaatgaggagagggagaaacagaaaatcaggaggacggaaaatgagaaaatgaggagacaaatcactaagatcaaatattcccaccgcatatatctgataaacaacttatgtttgtaatatataaagaattctttcagattaaaaataattttaaaaaacagcctgattttttaaatggtcaaaataaatgagttgatgtatcttaaaagaaaatatacacgaatggccaacaaaaacattaaaaggtgctcacataacagtattaatcagaaaattgcaaattaaaaccacaatgagatagcagtatacaccattggaatggctaaaattaaaatttaaaaggctgataataccaagtgctgacaagtacagggagcaactgaaactcatctacactatttgtgggaatgtaaaatgacacaaccaatttgtaaagcagtttggcagtttcttatgaattagacatgcacttactatataacccagccatttcactattagatatttacctacaagaattgaaaatatatgtccacacaaatatttacccaaattttcattgcatatttatgtttgacaaaaactaagaatgatatgaatatctatcaaaaagtgaatggattggcctggtgcggtggctcacgcctgtaatcccagcactttgggaggccgaggcgggtagatcacctgaggtcgggagttcgagaccagcctgaccaacatggagaaaccctgtctctactaaaaatacaaaatgagccgggcctagtggcacatgcctgtaatcccagctactcaggaggccgaggcaggagaattgcttgaacctaggaggcggaggttgaggtgagcagaggttgcgccattgcactctagcctgggcaacaagagcgaaactccatctcaaaaaaaaaaaaaaagtgaatggattaacaaactgtgttagatctgtacaatggaatactactcagcactacaaaggaatgaaatattcctacacacaacatcaatcaatttcatagacataatatttagcaaaagaaggcagccataaaagagtctattctatataattgcacttttgtgaattctggactagacaaagctaatgcattgtcattgaaattggagcagtggcgttacatgagacaggaggcaggagtgggcgactgacttcctaacagcatttagaactttcttaaggtgatgcaaacattcagtatcctgattgtggtggtgttgacaagctgtgcgtattctaaaactgttatgcaactgtagtacaattaaacttggtgtatttattgtacattaaaaaaatgcttcaacgaagtagatttttaaaataactaatccagatcatgacacttccctgtcatacaatgcttcccccatttcactcatagtaaaagctagaatccttccaatagccttaaagtccctaatgatctgtttcccctcctctttctgacctcaactcttaatactcgttgccttacttactcaatttttgctacacttggccttcttacttttcctggaacacgccaagcatgcaatcactgtggggactttgaactgattcttctctctgtctggaatgctgtttttccagatatccataacgtagctcaccctccacctcttttgggtctttgacaaatgttaaagtattaccttctaaatgaaggaccatctatttaaaagtgcattgcgcgtgcatgcacacacacacacacacacacacacacacacaccttactcttcttttctgcccgtttagcatagcaatctgttgtacgttttgtttactgctgtattgccggagcctgctaccatgcttggaacacagcaggctctcaataaaaaatgtgttgaataaagaaataatactgaggctgagatgaggatcttcttggagggggaaatgtgagaggggacaattagcaagccgacccctcagacgtgttatgtgtgacactagttgggcttctgtatgattaccttgtagcttcaagcaagctccaaaggcttttcccataagcaaattgtgtattattcatggggatgaatagaagagcctctaatcccccagagctggtatatggggcttgaggggctatattctaccctgaagccaatctttggggccaattccttaaaatatagtcagatggcaagtttgagaaagatgattagcagggaggatccctaggtctgaagatggaaagagacccttctcgagaaatagtctgggctttaagccaagcctcccaggttttcctgacctcagtaaattagtgtgcaccactagacctggcgattctgaggacaggagtcctttccagggcagtgtgctctgatggagagaaggaaggagaggtgtgggtgatggcaccctgttcagggaggacagcctggctgatggaggaggatagcagagctctggactgggctttggataatgggagggatattggcagcctcttcttctgagagttggcctttgcttcacagttctcacttgccagggatatgcacctctgagtctaacttttcaaagtcctatttcacttacttgatggattggaataaatggcagtctccaacggccttttgcagttgggtaacatcagaagctcaatgcctcctgactgaacaggtcagaggctgggggagcaggacactctgtaagctagaatctgaagataaggctttgaatcacagcttggcaactctgacttgaagccttgggcaagacactttccttcaccgactccctcatctgtaaaatgggatgctcaagccagcatgccagccctaccccaagggtaacatgaaaatcaaatgaatgtgttcctgggaggcatttcagtaacttcaaaggttagtacaggtatcagaggctattgttgtcaggttatttcaggtagcatgctgaccggggactagctggccaactggagtaactgggtacatttgaagatggaaagaagaaccttccagctcacttgactctgggtcaggtgagtctctggtgtaattgagaccaattatcaacatgcagttttttcttgagctatcagcaacagaatctccttgcccaagcctattgtatcaaaacatctagggcagggcccaggaatcagccttataacaagttcctcaggtggttctgatgactatggaagttcaagcactgcttcatatgtctgcccacacatggaatttccctagcctttgagcttatttctttccaatacttagctctgcagatggtcttactcattaaaaagaacacttatgtctggaggagtggagtgggccccacctccacaaagccatcttgaactgtcactcacatcatctagcctatagctgaggatatgcaagctgcattattaatcataaagaaatagttcgactgattgctatctaatctgtttaccaggtcacagctctagttaaaactatttggaactgctcaccagacattgcgagtcacctgcatgatcttggtcatgtatcccattagaatgtcacagttgttaagcgattccagcctttgggctttgctgagttcctgctgggtgggaggggagttagagacagaaaaacaaagaaatgttctctgtccttcaaatacagtgtcgactcagacctcccacatatacaggttcaatgcccataaggttcggggagcaggaggggacagagatggtgagaagcactaggtacagtgcttccatggtgcttttgtagaaggaggatgaccagcaattttgactcataaggttagtggaatggagccaaaataattctcatgtgcacctccttagcacaggccctattggttagaggtagttccatggtgtttgcttagcaatcctttcaagcttcccagacagcaataattaggtagaaaaaaaaatttgtgcaaaatacatagacataactagtaatttccagaaaattagattttctgttttgtctgggctagggcaataattagacaagaacgtagtcaacattaattcttatcccaactccaccattgacatgctgggtgaccctaggcaagttccttgccctctctgagaattactgtctatattgtaacatcaacagttttggattttgagccctttctgtcagcagtagaattctggaattccctcagtgagctactgactcaggagcaagtctggtccaaccttcagagtccactttctaaaaatatcaaataacccctataacttgacctcactattccctaaaaaagctcactgggtatttgtttggtttcttttctcactccctaaaagttcttcaaataaagcatgattttatttgaaattataaagcagcctgaaaaatttggagataattttacccctgggccttcctgctaccaaagagttctttccatatgagtgagtgagtaagctttccttacttcaaagtctgagccaacctggacatagaaagtagagcaagcttgtctaacccatggcccatgggctgtgtgtggcccaggatagctttgaatgcagcccaacacaaatttgtaaactttcttaaaacgttatgagatttttagtgatttgttttagctcatcatctatcgttagtgttagtgtattttatgcatggcccaagacaatttttcttcttccaatgtgatccagggaagccaaaagattggacacccctgttgcagaggatacaaagtttttagcaacctagtgggactctagagagccagaagtctagaaaacacttttgaggttttcagcttgtgccataatctcagagccagacctcagtcctttctgcctggtattgttctccatccctggggccctcctatatgagtgatttctcctgaaggccaactgctaattattgacatgacaggaagtgccacatgtaggcactttcttctgagtgaggccaggtaacaaggtgatgatcataaatcctgatatgattggtggattcttctttgggcttggttaactgtcagcttccaaattccagattttcagttgaagagggagcacaaaaatgaagtcctttttattgtattagttatggtaaacataagctactaaaaacataaccagtaatagagcagattaaggtgtgaatatacacatatgtttacatatgaagaatagatatttgtatctctctttcatgtaacattctccctgtgaatgatccaatgctgcataacaaggtcattctgggactcagtttcttcccttccaagtcattgctctcccattccttctatcccttaagacatgtcatcttttacatatttcaaacccagtggctaccacaaaagggtttcagccagcaagaatggagaagagaacatccactcttttagggccctggcttagaatgagcccacatcacttctacttctaatttactggcaagaatctagtcatacattcatacctaactgcagagtgttggaaaatgtagtcaccatgagcagccatgtgatctctaacaattatattatattgcaataaatgccaagtgggttttggtgggcaattaacaatattcgttacaatccacctacctgtccacctcaatatttgtgtgcaaccttatttgcacacacacacacacacaaacagtgttcacaagggaaacaacccacagcctcatccaattactgcagacacccattctccaaaatctccaagtgacacaatattggagaatatatattttttataggggctgatttagggcttaaacaatcaagaaatttggcagaccaggtgtgtgtgtgtgtgtgtgtgtgtgtgtgtgtgtgtgtgtaaaacagttctagtgagatataatttatataccacacattcaccacttaaagtttataatattctttaatgtattcatggaattgtgttataaaatgagtccattttataacattttattaccccccaaaatactccataccctttagctatcacttaccaccattccctttatctccttcagtcctaggcaaccactatctgctttccatctctacaatttggcctattctggacacttcatgtaaatgaaatcatataatacgtgaccttttgtgactgtcttctttcacttaacatattattttcaaggttcatacatgttgcggcaggaatcagtacttcaatgctctttatcgttgagtaatattccactgcatagatatgtcacagtttgtgcatttgtcagttgatggaaactgggtagttttgatttctttagccataagtttctctgaaattgtgtaaatatgttcatggattggaaaactcaatattctaatgaagccaactctcccaaaattgatttatagattcaacacaattctcaaacttccagcaggcttgagtatgtttgtgtgtgtatatgtgtatatataaattaacaaaatgattctaatgtttatatgaaaatgcggaggtccaagaatagccaaggcaatctggaagaatgaagtcagagggataacactaccagacatcagacctattacaaagctataataattaagaccaacgtaataacatagaccaggaaaatgcatataaacattgtcatttggtttataacaaaaaatgccacagcaatggtggattaattcaatatctatttgggaaaaaatgaattgacccccatatcacactagagacataaataaattccataagattacacatctaagtgtgacggataaaatgctaaagctcccagaaaacgatacaggagctcatcttcatagcattgggacaggaaaaacatatttaaaaggctataaaaatctcatataatgggagaagatatttaaaatatcatcaacaaagtctcatatacagaatatataaagaacttttaaaaatcgataacaaaaatgtagaaatcccaggggaaatgtggacaaaaggaacttaacaaacaaaacaaaaatattcaaatgttcaaaagaaaagatgcccaacaacatcagggaaatgcaaattataaccacaattacatactgctgcacccccaacagtgtggctaaaatgaaaaagcctcactatactatgtgttcatgaggatgtagagcaaaagaaactctcatatactgctggcaggaatgtaaattggtgcatccatttcagaaaagtgtttagccacacttattaaagctgaaaatatgcatgccctttgacccagcaattctagttcttggaatataactaaaagaaatacattcatttaccaatatgtaaaaattttaagagcaagcttattcataataacccccaaaatttgaaacattctaaatgcctaataaaagtagaatggatcttttaaaatatagtatatgatggaatattacataacaataaaaagaagtaactattgatacacactgcaacatggaagaacctcaatggacattctggttagcagtaacagctggatgcaaaagaatacaaactatatattccatttatataaaagtcaaaacaaacacaagtattcaatggtgacagaaatcaatataatgcggttatttgcttggggtgtgtaattactggaaggaagcccaagaggtgttctgaggagctgatcatgttcagttttttgagatgagtactgattacaagaatatgtttattaagctgtacctctagggattatgttcatttctctccgccccccctttctttatctccctctctgtgtgtgtgcgtgtcttcaataaaaagttaatttaaaaaacaacacgtgttagtatccccagggaagcaagaggtcaggggataagtggaggtatggatgaatttaaatttaccatgaggtgatgattgttgaagcagggctaaaaaatgggtacttgggagttcgccgtgctattctctctacagtttacccaagtgaaaatttctgtaacgatttttaacacgaaatttggtagacttctggtacatttgcttccagtcagttttatatcttagtctgtagacacagctcttaaacttgctttatttctttacttctttggttcataatgctctgcaccattttaggagtcgctccctgaaataagctgaaaacaatgggtttaggcattaaggcaatcccttagtctaatctttttcaacagtctctctctctctctgtctctctctctctcctctctctcctctctctctctctcgtctttttttgattggctgaaaagttctattgtaactttgacaatgctggtcttctttgtagccacttaaaattacttaagtagttgcctttcccaaacccaaggatcccacaccttttgactgcgtctatttccttccatctcagactgcaggtcagggaaattcttgtctgagatcacttctttttaatgcttttctaaaagcatcaaggaacagccaacacagacactgactccaatcactttctctagagttatagtctcagtaggcatcatactgcattcaaagttattttagttgacagttttgccatgctatcatgcttttcatgctttgccatgacatgaaaagttaccagctttcaagcctataatattaatattgttgtccctgcaacctacctgctgagatgttgttgcaatagtaccctacttgaagatacatttccattttagttagggtaaaggcaaactgttgtaacagaaactcaccaaagggatgactgagataacaaagcagatatttatctctcacttaagagttctgatgtgaaggaatctgattggcaagtggctcagcccctttgaagtcatttaggaaccatgttccttccaagttgttgcttggctatccattacaacattagcatcatctacatagttaagtatgggtggtcaccataaaaggattccagctggtaggaagggagaagagcacaaggaggagacatactgtgctcttaagattcaggccagaaagtgacatataattacttctgcttacattccattactgataagatagtcgtatgacagtacgtaactgcaggagattcttggaaatgtggtcttgctggatagctatatgcccagctacaattttattttatggaagaaaatgaaactagattcagctacacagctagcagctttggccacaccaatttcctcttgcttccttcacacctacaagctaggcttaacctttcacttgcatttatacctaaaggtctttatataacttagaaaaaaatttatttagcctttatcatacttggccttcccaacagtactgtgaggcaggcaaggtgtaaatttttggctctaatggaaaaagaaatatatcaaggctcaaattatctcccacacgagtggcaagcctgaggttagtactccagtcacctaactccaagcacgtgcattttcttttactatcctatgttccatctttcctgctttctaagagtcatctgcatatagttcttagttcagttcacctccattgttgccctgcgtactgctttcacacttaccaggacataacacagcctcacatgaacaagactctctttatcttgccagtttgatggtatgtgttcccaatgaggattcctaggccttgtcagaccaaggtgttttctgtcctttgcatcatttctttaaacaggttctcaatcccattgtacgtcactcactccctggcataccctccctttcgttctcttccagcctatgttcatcagctccttcaactctgagtccaacacacacttttgaacaactttcactatgctccctcaatattcatatccacagataatttatgtggctgcccttgtgtctcaatagttctttctttacactggagccagaatgctgttttaaagttaagtctgatcatgccacttgtattagtctgctagggctgccataacaaaatacctcagactgggtggcttaaacaacagaaatacattgtctcatagttctggaggctggacatcacagacaaaggtgtaggtagggttaactgctcctgaggcctctctccttggcttgtagatggtgtcttctccctgtgtcttcacatggtcttccttctgggtgcgtctgtgtcctaatcactttttctttatgaggacaccagtcacattgtataagggcacactctaatgacctcattttaccttaattaccactttaaacaccctatctccaaatgcagtcacactcagaggtagtgggggtgaggacttcaacttaagaatttgtagagggtccacaattcagcccaaaaatctactcctcttctgaaaagcactttaatggtcctcccatctcattcagagtgaaaactagtgtccttccaacagctctgaagacatttcaggatccggctcctgccacctatctgaccttatgtcctaccactctcctctttgcccactctgcttagtcacacttgccccattgctatttctttgacacagtgggcatgcgctcacccacctcggggcccttgtctttctcctccctctctctggaatttttcccctcagatatccacatggctcattctctccatccaattcccttatcaatcatggcatcctaatacaaataatgacctgaaccctcagcactataccaccccctcctctacttcatctatcttcctagcgttttccaccttcaaatatatagtgtcatggacttattttcaaagcatttcctcccacaaaatgaaagcctcaggaggtcaaggatccttcctgctttgcttgcttctgtatccccaagcttcaaaagaatccctgacataccggaagtgctcagaaaatatttgctgaaagaatgaataaggcacacttattgagaacacaactgagagagagagaggaagaaaaaaagggaaagcctccagagcaattgaaatcgtgaccacgaatcccaagctccatatcacatgcactttcttcagagagggccccctcaggatttcactcagagcccacaaactttagtttacataaaattctatgaaacgtaggtatttaaattccaatctcaaagtaaataagaagtagcgagaaaaagtggattcatgcaagcagcaagctcagtgatgatcataagaagtggcagttgacagattgacagcaaagaaagagaaaaaaaatcctgtaaaaagagagacacgccaaaaagcacatccatctaggccattttccataggaataaagtgactttgtctaagtggcaaccaagacaactgctgtcatggccaaggacaggaagcgaagtttacaataagaaccaggagtcattaggaacaggttacatatgtctggtgtgcttcctttccctagggtagaaaaataagccttatctgggagatgagtttccctcataatatggtttaaataatacttttcaagagcattgatgctaaaagtggtgaacttcctttcagtactcttgtgtagatccctcactccccaggctggaaaatgtgatacaagaagtatggttgtcctcagtgcagttctcctgctcactgcttcctgctgaggactcaaagaaatggcatctcgtttccctgaaggcagaaaccagagcttgcattgtcttccttggtaccctctttcctccaactcaccccgatttggctgatgtttgccttatagacttttttgtactgcctctccacaagggccacctagagaacagctctccagtctgcaaagccctcatttctgttgaagatgccctgtgaactttcactgggtcttgtttgccaatcaggcaaatcgcagccattcttcagtgacctactgttaagaaaacaggcctgagaggggatgaggaaacgtggctgaatccctgtgacacagcaggcagcctagaccctggacagagtccaaaaccaaaccagggaggcccagggtggatccagtgagtcaacaatctagggacatggccaaggttcagaactacaaggcacaatgtacagaaccgtgatccaaactgcaagccagaacccagtgactccagcaggagcaaagggaggagaaggctggggtaggtgtgggaggagagctgggaaaggcaaagttgcagcatccccagggtcaagagactaggcaaggtccaaaggcaagtggaataataactttgtcccatcaatcagaattctgcaggcccagctgcaggcagcttacgtctactttcacgaaagctctaggactccatcctctgcccagctctcttctggctcttcataagctttcccagggacctcagcaattgccacagcttctatcatgatcttgctgcggctgacattgctatctgaagaacaaggggaagcatgtggcactcagcattgagggacctgcattctagccccagctctgttcctttctgactgtgtaatcttaggcaagtcatctactttctctgagacacagttatttcagctgggaagcgggaaagataatgtctacctcacagagtttgggtgagagctaaataaaatcatgaagatagagctgctctgtaaatcacatagttctgtacaatactattcctaatattaacaagtcaatctataacctaaatatctgtcctacgctccagcctgatatattcaaccgcctcctggaaacttccacttggactcagagtcaacatatcccaaattttcaaaacccccatcttctagtacatggcttcctgtcttctctgtgcagcccatttcagcgaagggcatcagagacaatcagagtgtcggggtatggaacctgaaacctaatggactccgtcagtggaaccttcctttcccagcttacatacaatctgccaacaactaccaggttggaatgaatatctgacagactttcggccctttttctccttcccctctgccctgacctcagtcaaattctcaatatttctgtcccagaatgttgcaacacagtcttaagagacctagctacttctggtcacacacccatttcctcaaatccagacttgccatcacagccaggttaaccttacaaaacacaaatctgactaaactgctttccttaaatccttgaaagcccccttgtacacctaaaggagaaaacgtatgccagtttcacttctcactctatcccttaaagtatccactgttctcacctctcccgatgagaaacatcctgaacagaccaagtcctggccaacgtctttggcttttttccattctgatatacaaggagccatatcatggaatcggattcttcctagagttagggaagcctatttgacatcaagagtgccctgagacagctttcttctgcttccagtgatttttttttttttccccaaacacagcctcatacagaaagcaactgctgacttgggaatacccacagttctaaggcagcacaggcagctaacagaaccgtgttagctgtcatatgatgttagatttagttcttgttctagttcaagttctgccactaaagaaaagagccaactccattgtgatgtctgtgagatggtcttcgataacatgtcaagctgctgaattaagcaacccagcagcccacacacgaatggacttcctgttacaaatgtttttgttgtctgagtcagtctgagtaagggtttccattatttgcagctaaaagtactgtaaattatctaacacaataggtgacttaagcaataacacagcctaagtatgcaagggagtttctcacaccaaacaaacaaaaacagaaactgaggttcagaaaaagaaaaatgattttgccaagaacatactgaaaattcgatggttaattgcataaaatataacaatactaataactatttctagtctggattatcaggtgaataagccctgttctcttctagttttgctgttaagctgctgtggactggaaaaccaggtttctgcaagacaggtagatctgtttgtaaactaagtgtaaacagactctgagtgaagttccaaaagcttgtctatgaagaaatggcaggagctttagcattgattttgggacattgagataagtatgatgtctctatatacttggctaatctttggtctatatcacatcagaactattaggacaatgtgtcaattagttatttttcttgtgaaaataaataatgaatgtcacagagtggatgcctctatgtgtgtgtgggggggctcaaactatgcctgcctgagtgcacatagcacaagagtagtagggacaggctctctaatctcaagtttaactgttttgtcctggccaacttggacttgaaaagtaagggatgatctgattgactcctctaccttctctcagaaaattcttcacttaccatgtcaaacgactattttgctgtggagcttattgaaaagtgacacatgctgccctgtggaggtagtgagctcctcatctctggctcaaactgagtttgaatgccctacttgtgaggaagacttctattccaggaaaaagttaaggctgatgtcatcaagtcttttatagtctctttccaatcctgatttctcttacagcccttttagagggagaaaaatattctctgttgttgttcctgtcaaagttgcccatagaaacaggcagtatcaaagtgatctagctcaccactgagccctttctatgtcatacaagagcaccagcaataaaaatgctggaactgaggcccaaccagtgatatcactgatgatgcatcaggaaagacagaacacctgctctttacaaagacctttttacacttacttccctgatgagttcacttcccaatctgttggagcaaatcccttttgtaagacaggctgctacacaccataaatttgatggcagctcttccatccaaggagcctcttggggcacttgaccaatctcaacattcccaattgttctaactgattggcaagcattatgaactcaacaattggttttccacagctttgggaggagaaatgtctttcattaataggctacatttcaccagattgccagggaaaaggtgatactactggaaatgtcagaaagagattccctcttttcctccctaacctacagcagggcaagcaagcatggctggtaagggagggtaagaaaaacacaaagactcttggccaggcgcgttggctcacgcctgtaatcccagcactttgggggccgaggctggcagaccatgaggtcaggagatcgagaccatcctggctacacagtgaaaccccgtctctactaaaaatacaaaaaaatagccaggcgtggtggcacgtgcctgtagtcccagctacttgagaggctgaggcaggagaattgcttgaacctgggaggtggaggttgcagtgagccaagatcatgccactgcactccagcctgggcgacagagcaagactctgtctcaaaaaaaaaaaaaaaaaaaaaaaaaaaagactcttcagtgtagctgcttggcttcatcttcaccaggaagcttcctggctccaaaccattgctgaaacatctatttgttcccttgagaccttctgggaaagtctttcttagggttggggtaaggaaatatggcttctcaggattattcaagctcagaagccctgtcaccctgacttcaagctcagaaaaacaggcaagccaataaactatccagactgtttggtgcaaagtcctgcagctctgaaggatgagtcatctgcttttaccaccacttgaaataaacgataatggcttggcagcctttcgtatattaatagccttgtcattttgccttcctcccgctccctttattccacattggaattagaaatggcaaaagggccttcagagctgattaccctgtggttccaagcttcccagagagcccaagaggagaccaagatgttccctgcaccctgggcagactgagagtcccccccagtcattatcctgtagtcattcttcatggcatttcatactggaaattatcagatttatttccttgtctgctgattgcccgtttccctgcataaacatgtaaacttcatgaaggcaaagacttaatctgccctgtcactgcatcctcaacacccagaacagcgcctgtgagagaggagggaggagctggaagtgttaccctcctacaaagaatgagaatacacaaaggaggcagggttgtacattgggggaagggctttacgaaggtgagaactataggggatgtgggtgaagtaaccacatttctatatctctctgactccaatgtcttttgtgttaattactctgaatttccaagagaagggagagggtgcagttaatcatctccctcaaacctcagcaagacccacctcagccctccactgtgctctgtggtactactctgcatttcttcaacttccacggaacctctgagcactcctgtgccccctccacatcttcaaaacctcccactggcccaccagcaccttgctctaggagaaaaatgcctcctctactcccatctcatctctgaatactacttctacctctttgtccaaatccaactacagttcctccctgcctggagaatgtagcttcccctgcaggcctctcgactactcactcagtccttaacccaatcaatacattgtgattaggtaccagttctgggaggcaagtgaagagattcattctccacactccatgtttctcagagtctggaggtagggtagtcacctcctctaattctgcttccaaagggttacatctcatcccttcttgctgactcagtgacaccacggcactcctcttccctccctggtagtataaagggttgactctgcacttaggcattccccttggcatacacacatgctgttattttccccatgtaaccttctctagagtctccttccttcttcaacaactgccctattttgctgctgccttctgcaacaaaactcttccaaggaggtttctaagctcattatctctaattcctagtcttttgtgaacccacttgagcagtcttttacctctcctacccacccttcccaacacgcacacacacacgcacacaccatagaaatttttcttctcaagggcactaatgacttatatgttgctagccccagtggtcaattcttagtcttactcccctggacctgccggcatcatttgacagttgatctctctctccttgacttgcaggatgtttcactctcctgagtgaaacatcaagagatgttttcctcttcctacctcactggtcacatttctcagtcttgttccctggctccttctcttcttcccatcctcttcacctcagggctcagtcgttgtctcactccccttctccagctacatgcactctcatgttcatctcattcagtttcatggccttaagtgccatctctatactgatgattcccaaatgtatatatccaggctacacttttctcccacccacatttcagactcaagatcacacctgaatttggaagtctaatagacacctcaaatcaccatgtggaaaactgaacttctgacctatcttccaacaaaaccaaccaaaactccaggaaaaccaaactcccacaaaacaaaacagcagaaaaaacaaacaaacaaacaaacaagcaaacaaacaaaaacctgttctatccatagccttccccatttcagctgttggtagttctaccattctggagccatccttgacgtctctctttctttcacacttcatataatttggcaggaaatcttattgactccattttcaaaatagagccaaagtctgaatacctctcactatctccactgtgaccatcatctcttttgcaattgctgcagttgccccttaattagcccctctgtttttatcttcaccatcatcaatttattctaagggaagtggtcctttaaaaaagtaattcaaattgtgtcactcctcttctcataactctcccagtgactcccactttcaatcagaagaaaagttaacttcttccaatggctacatgacactccatgattttccagctcaatcttgttttctctctaacctcatctcctgctacttcctctttcttcactctattccagccacactgactttcttgttgggcctggaacatgttaataattttcactttttcttgattcttactagaacactctttccccaaacatcaccttctcagtgatgctctgcctgagcaccctatttaaaattatccccccatagcactccgaatcctacttatcagattctgcttatttttctccaaaccatttattaccttctaatgtgctgtataaatataagtaacttgtctgttccttatatttattatttgaggtctgtctcatttctctgggatgtatgcctcacaagaacaaggctttcaatttgcttttctcatcactatgatctttagcacctaggctagtacctggcacatagtaacatatattagttgaatgaatgaatgagtctgtttgtgtcctctcctctccttctgtccttccctcctctgaggaagaagcattcatcctccactagcagccaattctccccactgggctctgaccatacacacctgcttcatgaaggctttccaccctctccccttcaattggcttctccctctcagcctataaacatgtttctgtctcatgcatctgtaaaacacaaaaatcaaaatgcttcaaatatttgcctccctctagctgtgtcttccttcatgttgagcttcctgaggagttgtctatacctgctgatttcacatcctcctcacacattcacccctcagagcagacactttccagatctcaatattctcaaccaacatcatttgccagcattatgggaattctccttaaatctcttcctctccttctctaaaaccctctagcccagagcagaatcagacatggcccctgcactaagcctctctccctgtatttggtgtgggagacagtcacagttctcactgctttcgagccacttctcaagcaagctgtctacagtcatacgctcttttctcttacctgtccatctcacaccccccctcaactctgtgttgaggatcagcccctgcccgaagcttaccaataacctccttgttgagtcatccactggacaccattcagtccttgacttattagcacatgattaaaaccaccagcctacaagaaatgccctcccttgtgttggcttctctgacacccctctcaggactcaagcttaagcctgtttatctctccctgggtgactgcatccagttccatggtcttgaatgccacccatgtgccaggcaatctccatccccagtcatgcctctctcctcccttatagcctggtgccaccagcctgcagtgctcacagtggtccagtttcctgaggtctggaatcctgttttgtccacagcatttcaaccgccttgggacatgagcccttgctctgcagtgtatgtctagggctgaggtcttgctctttggccagatacttcctggtgttactcaagacctcaaggataccaggtgtgcctgcgctgtcatttatcagttattagctaataatagtaatgttgagaatggcaggtaagctttgttgagtactgaccatgtgccagacatggtgctaactgctttacctggtctttgccattgaatcatcacaggtgccacgtgaggtgggaagtattataatttccatttgacaagtgagtaatgtgaggttcaggggctttaaggaacttgctcctagtcatttagccagtagttaggggatgatctgaaattcaacctgtgccctgtgtgcagtggagcacagaggtctggtcactaccctgtactgcctctgcctccattgttagtctatctgctttgaagcctggttgtcccctgcttgctccttcatccacttctgcacttggcttagccctgtacatagttctttctctaggtgctttccccagtgtccctggcatctcggtcttgctgcaagcccaggtacttaacaagctaagagccatgtaagatttgtctgggctggtattttttccttgagctaataagaaaagcatgtgtgcatgtgctacagtttaggccatgctagggcatgaacacacagactttatgaccagcaactctggttttgtccctaaatcacatatatagtaggtcacatggtggtttgctgttggttatttaatttgataattcacaactgacaagggggttgctcactgctattccaatcaatgggtagtttggtttagttatgaaaacacagctgctgtattaacagttttgtttatattcagcttgaatatctagttgaagagaagcacatctgaagtacaaacagccagggagaggggtgtgcacccacacacatgcacacacacacacgcacacacacacacacacacgtacctagacactaaatgagaatgtttatttctaatggaactttaaaaagtgaaatgcaaaatgcagggagctgctatcatggctgtgactaaaagctctttctcctcctcctgccttcattattctgttctgccaccctggtcacccgggaagaccctgtgagccttttccaacaaacctccctcctttgcctcctccccaactccatctgtcagttgtacatcttagatgttgctccctcctgcggctcctcttctggccatccctgtggctctgatcctgttcactgggagaaaagaggctccagctctccatcccgcaaactctcccgcctacccccaccagagggatctttggaaacaacgtttggacgtacaatgtacccttttggtactcgtctgcaactcccctgttgcccacaggataaagtgcaattgcctggccagcctcccactccagctttatctccaaaaatttctcttcacaaatgcctcaggcaatctcctccttgttctctgtcaaacaccacacatagctggtttcaacaccctggctggctctcaatttggaatgtccatctctgcacctctgctgcctataatacccttttcttgctttgagaggctagagatcacataagtgttttcctgggaactctggggccctcatgactttgtaccttgtgttagtaatttttgaaaaaatagtaattttttactaattttaccacaagttcccactcctctcttgaaaaacatatgtaagggccaggacatcatctgagtccttgccatatattcctctatcataaagtcgatggcctgacctagacaagcatgtggcaaatacttgaaaaactacaaaataataataacattctgtagcctccacaaatcctcacagctatcctgtggatgagctatcccttcgatgaggtttataaggaagatggcaaagtatgattaatatcaacctgtaagagaaaagtgcctgggaatctctgatgagggagctgtaatcacttgcttcctttgtctgcctgggattcagtcgctcattcagcaaacgtaattaatgcctactggtcattggtcactgtgctcaacccaggggaatacaggtaaatcagacaaaccttcatttcccggaggtccaatgtcagtggaggaagagacatgcatacaggacacttcaaatcccaggctggctacagtaagggcagacatgctcctttccatagcagtctggtgttggacaggacggcaggcggatggactggcagccttctcttcctcatggcctcagcaaagccgcgtgtttgcctgttccctgctctgcggcatttctgcccagggcaaaactggctatataatttgcagggcccaggaaaaaagaaaaatgcaggtccacttgttcaaaaattattaaaaatttcagcagcaaagcatgaaagaaagtatggggctcttcccggtgtgtgtcggggggcgggggtgaggggctgtgcaagcctaaacatgtcctgcagtctcttctgtcttgcaccgtagtctgaaggcagccccaggtcctagtggactaactcagtggtagtaggacacacacagctgcacacaaatcagtgacacatttggttgagtgcctattgtgtacccagagctctgctaagtcttagggatacagtggagaccccaacagacacattttgtgtgtatgcatgtgtgtgtttgtccctgagcttacttcagtaggagagacccactgtaaacaagctcataaaaaatgcccaagataatcatcaatgagtgagcagtgttgtgaagaggacaaagcagagtgatgtgcttgggaggtggggtggtgaagagggtgttgtaggtgagtgtggtagagctaagcctcttcaaggatgcacacagccccttctggagcaacaggtgaggatgctgccagcgtctggcatcagcttggtacacaaatctttgccattccttctccttctgaagcaaatcagaagggtctagggaaagaagatgaagtccaagtatgcttgagactcttgacgtgtctcccctgaagtggggcactgccccttccccttccccctctgtgccttctcgtgtcttcttctgctatcacctggtgccaagtctccagaaagattcggccatccagtctcaaggaggtttccaaagcctcctctattccagttggtccctctcacactcagcttctggggccaaagcgggagccacattgtggcagtgcccccttggggttcagagaaaattctccagtgaatgtctccgcctggtcctctgttggcgggtcctccctgcccccaaatacctgggaatttgccctgtggaatacctcacatcagagcttgctggggagacccctgtctctcttcttctcggtgccaaggaaggtgctgagttacccggcttccttcatacgacaagacttgtattccgaaggactgaagattgtgggctgagagctgggaaaaccagagagggaggttgaagccaggacacttggggaagcaatggggtgcaacaggtggcggggaggaagccacggctggagagcacagtttgaccccgcggcgtgccagcgggcaggagggggtcgcctctggggcgtgagcacatccagccccacatcttgtccctgaagcagctccctgccggccacagcctggggcgcgagtttcccccgcccaggccccgcgccgcgggctcgccgcctcctccctccgcctcccccgcccctggctgtctggcagcgccgcagtggcggcgtggggacggggggcctcagcaaccgggctcccgcctccttcccgcgcccgcgcgagcctccccggctccccaccgcagcagccgtcacgtcgtcggagatttccatcggggcgggcctggggcggggagcgcgggacggggcggggcgagtgggaggagtgaaagttggagcccagcaaaagcctccgccccgcgctcagtgcggccagagcgtgagccgcgacctccgcgcaggtggtcgcgccggtctccgcggaaatgttgtccaaagttcttccagtcctcctaggcatcttattgatcctccagtcgaggtgagtctccatcccgggacccgggagcccttcgcgcccagctccctctccccgggagccgggacggctcccgggaccccagcggccccgcgttcctcgagccccgcgcccgctttgccccggccctaccgcgggctggccgagtcccgcgtcccctcgatgcgcgccggcctcggcccgcctcactgtaggatgggctcccggggtccttgagggggagctccaaaaggaagacaggacgccagaaggaagacgggactccagttcgcggattcccgctctcagaagcactgcggtggcctggtgacaagcactcctcggagtcttgcgcaggaacaggggagcggccccggggtgaccggccagggcaggcttcagctactgggggggccggaggtgcattttgagaagggggtgcgcgggctgagggagcttagctgcgccaaaaatgtgtgagtgttgcctcgtgtgttctctgctgctcacattttttttaagagtgcctactgagttccaggcactgcgccaggcaactctgacattacttgcttcccatgccgctgctcctgttggtgccagtctcaggcacgagctttggtttagtctaagggttcccgcaccagctatgccccctctccaccgctgacagcctcccacttccttaactcatccctagacaccctgctgggccttgggcagactggagccagaggccaggaatattattctcctctgaagtctgtggtttgggccgtagatttcaatccccttctcccctttcaggtttcccttgaacaaccatcttccctcacaccttctcctcgccctgagacttggctaggagggtcgtgccctggatttgtggctttttggggtggaagatgactgcttcgttttgttgttgttgttttgagatggttcctgctgtgtgtgaagtgtcacaaatttgcaagcttcctgatctgtggagctttctcgaagattccatggcactgggcttgtgtcttgtttgtctgttctggggagggagggtggcttctctccctaccccagattgcgttagctcatcagagaaggggatgtgtagctgcttgctggctcactggtgccctggagtggggctagcctcagcaggagcttgataaatgtctttctatgcgtgctagcaatttccagtcatccacatccctcaaaatgggatgtggactagttgagaaagctgacgtggtgactggctagggcaaaagatggctctggggtgggggaaataagaaggggtggtcagagaggaaaacagcagggaaaagggactggggaaatggaaactgcccttcaagcatagcaacctgtggtgtcaggaaagagctgaggaggtgacaatggggtgtactgggccacactgaaccagaagacctctccctggtccaggcttagcctcaaattagttgtgtgacttggggcacagtccttcctctatctgggcctcagtttgtccatctgtagaatgaaaaaaaagatctgatttagaaaaaaatccaacatcttttcttatgcgcccctcccccccccacttctcacaccaccaacagtcgactgtttgggagggggtagtgcagagattcaacttcatgctggaccattatgtctagagacatgtgaatgtctgaaaaactgccctggaaaatgccactattccaatgtgtgagtgtttttcaagtttttattctgtctagccccgaaagtgagcttaatggctggctggggaaaggtatgcattgtcagcagctctttaaccccaaggacctcaagatgaggttttgttttgtttgtttattgttgtgttttttttttttaactggcaaaagccaattttaggattaaagccaccttatgaccctctgatatcatttttattgcagacctagtctaggggcaggagggctttggtggtctcagtgctttcaggtttatttgtttgcctctgcacttttaaacttggggcagcggggaggatctcgtccatggatttcagacatctgggaggggctgcttcaggcgtttaggtggtcctgtctggcagtgctcagtctaccactgactgccagttctgattgtgccacgtttccagccacatcactcattttacagggtctcagggctccatttttcctcctctcttcccatagtcactggcccttatcttttgagatggctgggagtttggcctcagggaaagaggacatcttctagatatggcatttgaaagtagaaactgtattttccaagcccagttcttccctcgcccacaatgggaagtagccacttcagacatgagaaatggtgtggatttggcacatctgtatgccacttaagcaattctaacagcttgaaatactgcagaaaaaatgcattttgcttcttaagttggcagtcccttggtccgcaatacaggggtcatgccaacgtctcttgccctgtttaccccttattttaggaaacaaattgccttatggcttaaaaaaatccttttggaagtgtgacgtgccagtagaaaagcatagacatcatgagtgaacagctcagtggcttttcacaagtaaacaggcccgtgtaaccaacacctagatcaggaaatacagcattgcaaccccctcaccacacacacacacacacacacacacacacacacacacacacacacagacacacacacacacacacacacacacacacacacgcatgcatctccaaaatgcctgtccccgtacactttcctccccaaaggaaaccactctcctgccttccagtatcacagattaatatgggacgatggcttttaaaaagacttttaattataattttttaaagacatataaaggtagggggaacagtgcacccccattgtttgtgaactcatggccactcttattttcttttacaccacccaccctccaattccaacttagattgtcttgaagcatatctcagacatcatatcattttatatgtaattgttttagtatgtatttctagtcattaatatttcacaaacataagaaaataccataattacaccaaaaattaaagaataatttattcatgtctcaactgtccactcagtgttcaaatctctcctattgtgtcataaatgatttctgtttgtttttcaagagtttgcttttaaataaaataagatccagatattagcaagtggggcattttgatttttaaaaacactttttatggaattagaacatgtatacagagaagtgctcaaatcataagtgtacagctgatgagttgtcagaatatgaccacagcggtgtaaagaaagccaaatcaaggacccgaatgtgagcaggacctcagaagccccctttgtcactgcctcccagcaaaggcagcactatccggacttctaacaccatcggtgagtttcataccttggcagatggcctttaacatttttgtttaattcaattattcttactaatcttcttctttttcttggctgtggtgcatggctgtggagctcagggtggactcctgttgggcagccagttcctggatggctgtctgtgggtggaggactcctgcctttcctgtttagacacccacaaaggctgctctttagcctccttcccttcatccccttcccctgcccccagtgcaacgagtattacacaaccaacaaaaccgcaaaatattcccacaattttctggtcctctctgggagaggccgctctggctttcgcaagcattcctctcagccctggccctctgcctgctcctcactcctggttggtgctggtcaggctgactagaggccaaggctagtcacagtgggccagcgctcagacataaatgccctcttcatttcacgtgtaacattcttttaaaatctaggtcttggttttgttgattttttcttaaataaaagagtgatcataaaagagggacagcatagaaagtccccaaagagcagcaaggtttaaaagaaattcacaagcctaatctgtcactgtcttataatttgctattaccagtcacaatttaactaggttttgtgttgaaaacttgttttggtttgcttctgtcccaagaggcactagctggggcccctacagagtgcagggcagagcttcatttttcgtttgaatgttctagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggaggtgaggagcagaacgacgttcttcccctcctagagggtccaggggttgagggcataggcatggagaatgcacctgggcagtaacagagggtgccatgctcatggacaggaacatctgctattgacctgtcaggtaagagatattaactctattctcagcagtgtcattgaccttgatcaagacttttcccttctctcgccctcagtttttccagtggtaaaatgagaggactaaactagattgttgatcttcaagatgtgtgtccaattcttaacagtccgtgagcttggttttgccatgaaagaataaataaagaaataggattagatgctgaaactgtgtggtccaacacttacttgactcccctttcatcccctctgaccacttcctcccccgtcccatgcgcctgtttgacacttaccctctgctgcttctgcttcccttatagagaagcccactgtggtcactgttgagatctccgtcaacagccttggtcctctctctatcctagacatggtgagtactaagcttttttagtactatttcctagcccaggggctgacctatgggaccttccacagacttctgctttctgctctgtacttctgtaacaactccaataatttattttctggagggagaaagggattttttaaccactggtttgagaatgagactggaaaaggtaagtcccttgctacttgaagaggatcttcagaatcatgaccatatcttccagttttttcattcaaaatagaaataataaagcaatgttaaacaccacaatggactgcctcttttcttctgataattattgtatggacataagtctaaagttactagctcttgctctaagactgttctatatttttgctctacttccttctttccttttccactcgtatcatcatagtgtcagcactgcccccatttggctttcatcatctcccacctagaatacacctactccacctactaagttggcctcccaagtgatgcacctcctgcagtcccagcactgcttactacatgcagttgaaggccctccatggttgtattcctcttcacccttttagagaccacgtgctttggtcacactagaatattggtgttcccagaccaccttgtacctctgagctttcattcaagtgatcttctatttggtatgccattgttccactttcttacttgtcagctgccttctttttcagtatctagctcagacagcatctcattcatggcatctcccctgacctccacacctgttaattgctcctttctttctcataccacattcttctcttcggcagttacatctttccagcttatatcacaggtgtttacctgatcttgcctacatcatttcattgtaattatctgtggtatgtcggccttgctgtcttctccatgaactccttgatgtcaagggctccatatatgttagctaagcaaatgagtgatgaatgatgctctgcaagaatcacttgcatctgcagagcctgacactgaggaaggctttggtaagcaactccgtcacagccacagacatggcttggcccggggcaaacaaaattttggcatactcacaggtactcaaaaagtgccatgtgactgggtgagttagagccttggctctgagatgggccttgcaaatagaccctcaatgctaagttaaccttcatggaaaatcaaggtgttcgcataggctaagtggaaaagcaaggttccccactcccaaaccatgaggctttggctgcctgattcttcaggcacactacctatgcattactatgtaacaaattatccccaaaacatagtgtcttaaaacaacaaataatcattatctcacagttcgtgtgggtcaggaatccaggcatggcttagctgggttctctgtttcagggtctctcacaagcctgtaatcaaggtgtcagctggggctggagtctcatctgaaggctcaactgaggggggatccatttccaagaccactcacaggattggcaggattctggtcctctctggctgtggtctggaggtctccctccatccttgccatgtgcacctatccacagggtagctcacaatatggtagctggcttctttcagagtgaggaagagtatgagagaaggtgctcaagatggaaatcacggactttttataatctaattttaggagtgacatcccattgcttctgtggtattctcctcatcagatgcaaatcatgaggtccatcccaagtcaagtgtaatccctgtcaagggattacagaagggcacaaacaccaggaagtgaagagcactggaggacatctcaagagtctgccggctacacatggtcatgatgttcttctgttagagcaactcctagaattgagttgctgagaactaacaagaacagaagcatgagagcagatagatgtttttgagtttctgtctacattttaaaattggtggggttttcttgactcttcccttgataatcagatttactttttgctgctaccagtgcgtttaccactatgagaattgtagtctccttttagtcttgcaatttaccttttaaaaatgggtatgaatttagcaattaattttgctagcattgtttataaactaagaagcactaagttctgtgcaagaaccagaggttgagggcttgtggtcccaccattgttgtcactgttgaccctttcaggtcattggtgtaggagtggggaaagtggctcacgatgctattctagctgggcagagagcctcctacagcagtctctgcctatcctcttcagcatgccaaaagccaaatgtagtgctcagtccacagtaacctcatggctcccagaaatttgcatagctatttatttgttcctttcttctagttctctgctcctttggctgactaaggcactgccaacctgatttggaagtaaccggtctaatttccacaagctggtttgccccttcttttctagcatgtcaatctccacccatttggtggtggctaaatttccttaggtggagtggagagaaccacacactgacaaatggagcagggggcgccaagatgcttcggtttgctttctgggtgagacagagcatcctgtaaaactgaagagtagtggagaatttgtgactaaaatctccttgctgtttgggaagccaatttctatctacaagagcccttgtagcagagcagtagccccactcacagtagctgaatgcgctgtctctccttgctccatggctattcatgctgccagcagtggcctcacctgacaatgcttgaaggatatagtctaataacccagcagtcaccaaacctagcatggaacacaggactggttcagaaaagagacagcaactttattttctttggccagtaaggtggcactttagcctgagccaagtgtcttttgaaaattccaaaccctcacatgtggtgttaaattttcctgaaatgccttgccttctacatggttccaaatagttctttaaagctgtgggaggtccctgttctgtggtgtacttggtaaggaggggacacacgtctctgccacatagtcacagaacataccagtacccagtacattcttgtctccttggatcctcatgacagcctgcatggaagccaaagctgccgttaggatatggatccctgttttacatttgaggaagctgagacttctcagaaatgtgagtcccagcattgggtacatagttggtgtagttgcttgaggggagtttcaacacctttcagtcagatgttgtttagaaagcaggccttgtcctccgggaaggaaacctgagtgcacagttgtgtaacacccagtctgagattaaaaggcaatgaacaatctgggaatcgctgcccatcatagcatcgatagttgctaacgctttttcttgctgtggtaattatcgcagttgattctagttccaaaacactgaatttctagagtttcggctgagctaaaagggatgtacatcgcaagctcctttgtcaaactggggaaaaagtgaactgttagttatcggttgatatgtaatgaacttacagttgtcgaatagaaattaaatgcttatttgaaacacttcataacatagagcataaacacagtgtgagtgcagagggcaaggcttcccactggctaccaagcagttcacgaggcctgggaatgaaggaggctctgctggccaagtttagactgccagccacttgggacagtagaaacacttggaagacatttgtggaggcaggtggggcaggtcggggtcagaggctctcattcaaatgggagccaggctctgccagctcttttctgtctgcttctctggcctactccagggaacattctcagtcttcccttccatggctggcccccagcagtttggtggctgcttttacaatcttttgtcctggccagcaaaggcaatcagggattttcttgatttcttccccgagggctgtgcccgcctccatggttgtgggtattcattgtttgatgcacaagaagtcagcggaaagacctagggattctgcagagaaaattggaccttggtacctaaagagattgttggtgcaagtgaaagccatcccagggccaggctgccattgactatttgtgtgactttggatagccccctttctcataaagccttagtttccttatctctaaaataactcagagttctgccttggcctgcttgtggtacttgctgttcgagctgcttggagttctattgcagtagggtttttttctcccttcaccaccagtggtgcacatttctagcttcttcctattcaatatcattgttgatgtttaacagacattttatgggacagacaatatctggagaccaaataatcacggatatatctatgcacacgaacacacacattcagaggttacaggtgcttatttgaaaggaaaaacaaaataagcaaaataaaaaaagattctccttgtttaaaaaacatgagactaaatagaggtttctcttgtgactcaaaacactcctttcccccccagctcccctgagatggagtctcgctccatcacccaggctggagtggagtggcacgatctttgctcacgtcaacctccgcctcccgtgttcgagccattctcctgcctcagcctcctgagtagctgggattacagatgcctgccaccatgcatggctaatttttgtatttttagtagagatggggtttcaccacgttggccaggctggtcttcaactcctgacttcgtgatccgccctcccagaaggctgtaaaacctcccagaaggttttaaggaagcataaaaacaactggatagttgtggtgacacacaaaccttaaacatgtgcctcccaaagtgccgggactacatgcttgagtcatggcgcctggcctccaaaacacttcatttttattataattctggagaatgaaggattggggttaattaacactggtgctccccaaataaaagctgaaaggggaaactccactgtatgcaatcaatggtgtgtgtgcttgtaaatttttaaaacaattttgagctgggatctttgatttactatggaaatgtggggactgagagggtgttgacctggctggagtagcatcacagcctacacaggagcaataagatgaagagcccagcccatggaattaagccaccatcgcctgtctgtttctagatgaaatgtatcctctgagactgtgatctagttgggaattatattttattttggaacacctggaaatagaaaactcctacagccaaactcatgccaccttcctctgtacaaacctaagtggattccaaagggtccatctacttgataagcccatcacagaatagcatggaacctttgcccactggtaaagggagggtgtcaatgtcagctctggaaacagggcagttgttttgaggaggagggcacttacaaattatttatagtctcccatttaacaaagaggataacagagaaagatacgagttttagccaaggtcacaagaacatttatttaagactttgattataaatggaaacaattctacagaaaaaaaaaagtgagactaattgtcactagagtctaacagttctccttgcctccacattaccttgaaatcatttatttgtagggcgcattcagttttctgtagtgtcagtcagtgtcttctggatattttctaatctttttttattttgacataattccatgtttatatttccacgtgtgggcgtagtgtacagacatgtcatttttagtgatcaagtcctatgttgtcttatcgtttgcctaagtgaaatgttctcttattctcacttataaggaaacataaaaacaactggatagttgtggtgacacacaaacctgaaacatgtgctaatgaaaatcctcagaatctataacgtcagagctaacagtacctttaaagatcaccaaatctcacctatcccattgttgtgttcatgttgatcatgtatacctagtgatcataggcttccttaattcagctgcattaatccagtagtcttgactatggtgtgaccaggaaggtgctctagatttcagttttatccagtagtgtctttcaatttgctccatgtcagtaagatctgcatggaccatagtcacatttgccattctgttgggcaacactttcccaaagtgtggaatcattttcaaatgtgtggttgaccttgtaggataaacacagcacaaagtgagtagtagtgctatggaccaagtactaacaagtactatcacactttggtgaaaagagtcgcctgtgagcagactgtcagttgactgtgcaatccttgcagatctattggtaaaacaagtggttgggttgttgaagctgaaaacttttagtcatgaatgtctaccctagagaaaagactcaggagggcaagattccagtcttcaagtgcctttccttgattcaatgttggctctgatttaagatcgtaaccaatttaagccactgtcaagaaagaataagaaatgccccattaaagatatgtgtcaattgtaaggtgcaccctgacttcagaaatgtgggaaaaagacagattcaatgacgtatcatttctggagatctctcctctggaaccgaaactagacttgctctatgtgctacctgagagcacagtggggattctaagagaaagtagtagggagctttgtttaaggcaaacttttctattgtcctgagttgtgtgagaattgtgttaactgctgcatgatgtgaggacctagctccccttgctcacggtaatcaagcagggcatgactgacttctcatttgggatcattaggcttggtaacctctgagttcccttctagttctgacattggaagagtctttgagcagagagaagggacctcatctgactcctgcttcctggtctagtgctcaatgcattccaccacattgcctttaggattctaggttagggagtggcaaacaatatgtttgcatgtgaatgtcctttttctgttcatccccaagtatgtgcttttctgtccttcccaccaggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggtatgtcaagcctctggagtctcacttcctggaattctctctccccttctgataattttagctaaagatccatgggcagagatctcatcctgaatgatacctctaagggcctgtccagctttcctagaccatgagctcagcccccttatgtaacagatatagaggcctcaaaatagaaagatattgcttaaagccacacaccaagtttgtggcagagctggaactggtactcagttacttggctccgagtccagagctccctcaactaggatgtgccagtatgactgcattatctagacaattccatcctacgtgggcactcgatacaaagatacgtccacagtggtggaattgttcaggcagagcagcagcacggtagtggcaaaggtacctaagatcaagttggatacttgaattcccagcaggggaaggttgtgtgtgggggatagcagggaggatgttggcaggtcctggaaactaggctgggcgagaaaacaaaagccgatcgaagttgctccatacgtttctctaatgatggagcccagagtaaccagatacttctaagctgtttgtttgttttgttttgttttgttttgttttgttttgttttgttttctctcttgttatctctcctttgagctttttgtcttaaattctagcgaggtccaggcacggtggctcacgcctgtgatcccagcactttgtgaggctgaggcaggcagatcacttgaggtcaggagttcgagaccagcctggccatcatgggaaaaccctgtctccactaaaaatgcaaaaattagcagggtgtgctggcactaattccagctactcgggaggctagggcatgagaattgcttgagcctgggaggcaagaggctgcagtgagctgacatcacgccactgccctccagcctgggtgacagagtgagactctgtctcaaacaaacaaagaaaaaaattgactctggccattcattggtggtagtccctagaccaaagctgggtggatacggaagtgcttagggccagcctgatgaggctcctttctcccttccaggatgaccattgatgccggatgctcactccacatgctcagatttccaatggattctcactcttgccctctatctttctctagctgtgagtaccttcttaagtttctggggccccagaaacatgctgggctccttctttttctcatccttgccatttacatttttctgcctctgcttttcttctaaaatgctgccaaggttgtgcaggacttccatcctccaccctcatttcctttcctgccaacaatactgtgttgctcatcccttccacgtgcctctgaagcgtatctcaagtatgtctgctcctctccatctccactggcactaccttggtttaggcctttgttatcttccacctggacttttgccacatcttcactttgaaactgcacatgtccaaaatgaaattcattgtctcctccaaacctctaccaccaaaacaagtgtgttgcttctgggttcccatctgtctcattgaagaggaccatcactcacccagttgcgcaaatcaagaactttgatgttccctctccctcacctcctgcatctaatcaatcagcacatcctgttggtgtttcctcccagtctctatcgatgctgtctatttctctgcaccctgtacagctttgacttccacctgcattaatttaattctgcctggattactacactggcctccttgacaacatgttgtcctcacagaaggaccagagtgacctagctgaagggtcacctaggttgggtcacttcttagtctcgaatctgccgttaactctcatggatcaatttgaaattccttagaatgaacctcaaggccattcatgaactggaccctgccacccaatcctgtgcacctcatcctctgtgagctagccatcctgaacttttgtcctttccacaatacaccaggtgtttcacctttctatactgccccttaaccccttcaacctcattcttattgagaatatttacttgagtttcaagatttaatgggaatatcacctgctttatgaagtcttttctgagtatgtccccaagtgacctttatctactttgtttccccgctgttctgtggacataggtttttcagagctcctccaaaaatcacagtagtatactcactgtcttataaaattaaatgtgattgcttgagggtagggttcatgccttgctcatctctgtatttctggcctagggcctgatactgaggaatgctcagtaaacgcactcattgaatggacttcaacaatgaggtaagagaggcaaggtcccacagctggtgaggccagagacaggactccaaggcattgtgcaggctgacttcatgctattggagacctcaggtgggcttccaagtctcataagaccctctttctcacattcctttccagtttcctatcctgagaatgagatgatctacaagtgggaaaatttcaagcttgaaatcaatgagaagaactcctggaagctcttccagtttgattttacaggagtgagcaacaaaactgaaataatcacaaccccagttggtaagcgtgccagggcttggcggaagtccaggaaggtggtagggatgattggagatggccatccatacaaatgctttgcagtcatcccgtgcaaacattgtaagacatggctcctgtcttataattgctaagcacttacaactgtttgcagaggaaactgagactttgtaactatgtctcagtctcatctgcaaagaagtaagtgctttgccaagctccttgagaggttaggtaagtagataaagttctgctgctgtcggaatgtgcagctggctttttcatgcagacccttcagtttcgaggttacaactctgacctctttggatgactttggggaatggagctcgtgtgagttctccatacccagaaccaatccagtctggttgaatgggaagcaaagtccattgtagtgggaggtggaggctagagttctaatgtcagctagtttaaggctgggaaagtctggaggaagttacagcagctacactggctgctgcattgacatttatcttaaaggaacaagtctgaaaagcacagattcttatcaaaggcttcatggtggattccacatagacatagtggccactggttttctgaccttttctctgacaaagactaaaggggaaggtcctgggtatcttacacttcagctcccaattagatgtgagcaccttcacttatgttcctaggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccatgtgactaggcagaaaatctgcttttgtttcatttattgagtcagtctctggatgagggaaagctcatgctcatgtggctagagctttgcttgcacagtattaggcaggggcagagggctgggctaccttaaaaatacttgccctttttcttggggactctggggaagcggttttactacctttgacttgggagccttgctcttctgccagctaaccatgggcctgcctcttggttttctgcacctcagcttttcccggataggtggggacccatcatcaaaagtgacagagaagataaggcccaggggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaatcttcgtgcaacaagaatatattatataaacccagcaattttgcagggcctgggtataactaattagaagtgtcttaaattgcagtcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaaggtgagtacgaaaggctgctcttctcattcagctccagcccacccagacctgctgggcagttgatccactttccaaaataggaggacacacggacaggttagtgttctggtctgctttacaaagctgttgcctgacaggagcaagagttgctgagtgtctgctgggttccaggctgttctgagcttggatgggcaggggctaagccacagggcctgcatgagccctgccttgaagggacttaaaagacgacctaattataggcctaggaattttacagtattgcaactgcaatgtgatgctgaaagtggaaaatgatgtcctgggctcagagaaaagcccacaccagcctgggagtcatgatagcagcagagtgcttggggagggtgtgtcagagcataaagcagcatgaatgctacaaaagaagatgccaactagagatataggttgtcatcaggtcccggaggagccatgaccgtctagctgagagccatgaccaaggacacaatgtccaagtgactgtgaggacctcagtctgccctgtggatgtgtatgccacagacctgacttctggagggctgactgaaatgttcattttaagctttttcttctctttccctgaaacactcagtttgggttaggggtcatagactaagaccaaagagtccagggttagaatcttggtgtaaaattgcaggccatctcaggaaatctgtgagcagatgggattggctttgggtaaggtgcgtgtggaaaatgtcagtgggagccgggtcatggtgggcctttagcatcagattccagagtgcagatagtctgtatagctcatgtgaaacagggagccaccaaaactttggggagcaggctagtgccggttttgaccacctgtggagcagtgctcactcacgaaggcattttgccatcacatgaatgtgcagaaaggaggccaaaagcattctgtgcttctccaccacagcacagacttccctagtctcatttgctgagagtagacattctgagggccagcagtgcaggtgtgatgtgcctcagagggtatgaagcccttagtcagccatctggatatcagctgcgtgggcatgatatctagaaggctaattgattttttcactttcacctgactctcttgccaacctgcagagacagacattgggtgtaggacagtgaactgagaaggaagctattaagattctggccttggcttagctctcaactggccattggtcttgcagtaagtcttttttctgggcttcttctggtcctatttgtatgtattgcattgtcacatcatgcctctatcctagggaatactgtgagctgaaaaatgagacccttactgttcacgtcctgctaagggggaccgtcgtgtcagcactgtaatgcagtgatgttttttgtgtctttcaggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctaggtaagaggagaaacaggtatacgcataggcacatggctgggagttggctgggccagggcagagttgccttgtcatggagtcttttaaccaatgtcgcacataggtcaggagctgagcccatcactcttgtgctcttgcagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatgtatgagctgggtatgggagtggtggcaaggctttggagtgtagagacatgctagcaagggtactggggttatggcacatgggtggtcagcttgctgagtgatggaatgttacccagggtggtggcggggttgaatcaacttcctgatgtaatggtgagaagttggaggagagaagccaagatatggtgtgccaaagacagtttccagaaaatccggaggcagcacttagacttgggttatcttcccttgacttttccccacttctttccttgtccattttagcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagcattcaaggtgtggctggtttctctggtgttcaagtttgttctcagcccaggttttaaatctgaaatccatgacccaagtgtttgctcccctctcccatccataatttccagacctgccaggcatggaccatgtacccttctctcattagtaaggaatgggaatgaagggagaagtgcacctgggtatgtggcaccctttacagtttcccttaattgctcctatgcccctgctggctccgtgtcccttttgccttgcctatcactctagccccccttatcagaacgagacggttcctagggaccaccagactcaaaacattcccctcctctaccatggaaagatgaggattctgaggcacagaaaacaggagatacttgtctcctgtcacacaaggacttaatagtggagtgggactggaccttagaaatgctaataccctggccaggcttggagcaagcctggacaccttggattattcacctttcaaaataagagagtctaaaggtatgctgggaagtgtggccctggcatcctgtgacacttctaactctaaaggaactcagaaacaataatgagaaccaaagaggagacaaaaaggctatatttgaacagccatttttgccataaagcctttagaatgatgctcaaacactttgcatgcaagaaactcacagaaaatataaggaacaattttagaactaggaaagtagttcctcactaaagatatagggaggaaaaaaggcagtgtggctcttgggcaatgtagacatgcaaatttgtaagcagtcatatttaaacggattttgaaacacagaaatagtgcaaaccagattttgtaatcacactgtaataaatctacaaatacataaaatccctacatcggtaaatttttagaagctcacataaatagttattttgaaaggaaaaaattaaaatcataattaagtgcataatatctaaaaaataaaattaatgaatgacatgcagccaacactgcacttagagaaaaattcataatttaaacatttcaattactaaacacaatggaagaaaactgagttaggcattgataactagaaattggaaaaaggataaaaacattatacattagaaaaatttggagcgttaaaggaattttaaaaataaatagcacagggaaccaattaagcatttgaaaaacaagaaataaagctaggtccctatgtctctcctcatccaaattacagatgaatcaaaaatttaaaaactttttgaaaggaaaccataaagacactataagacaatatgggtgaatatgtttatattcctggaatgggaaagcatttctaagcatgacgtaaaataccagaaacaagaaaggaaaagattgaaaacagtgttcatattaagaaataataacaaaaaaaaaggaaaaaaatgtagagtaaaacacactttcacattttcataggtcaggttttctgggaagcagtctttgagaccaagattagaaggcaggaagttggttgaggagtgctctttggatccctgcctttgggaagagtgcagggaacaaggtgaggtggagaagaaatcggactatgatgcattggctgttaagagcctcagattaacaaattagaagttctcaagctgagatggtccttctgaatgatcacaaatcagggcaagggggatgggcccttatattctctcactgaatgtgagcatgagcatgggtatgcctgagacggtctcagttaaaggctgtcagcctccaacaatctcagcagctggagaagtgagagctgtgcccaacgggcagtggtagaggaaggacttggtggaacactacagcatccacgatcattcatcccttacctcgctgaggctcgtttgcgtcatacaaatacacaacagaatcatcttcccctggttatgttgagcttcttttccttagaggatttacaagactaatgaaacacactactacacatctgttatgggagctggtcttggggccttaactgatactcatcatctctgtcctgtactactcatttcagaattcctctcacccttagctagtatctgcttatctaggtagcttacctcatggactgactgaaaccttcacccctggaggttctgagcctctggataccatgtcattctcaggccatggctggtggacttgtttatcatttctaagggatatctaaatgggtcccctggataccaaacttattcttgcctgccccaactgtaaagaaatggcatgatctcctcatggtaattagaatcaattacccctgccaggaaggtgacttgttttcttttggctggtgccaaacatgaccaagcagcggccatgggtaaaatccgatggaactcttgtgttccctggtaaaggcattggcaatctggaagctaagagctctaaacctgtaggacccagaactatgaaaactggagccacagattcccctaagtgggtcaccaggagtggataagcaaaacaacttctacttctactcctcagttcccaaacctgtacattctaccccatagggtgcaaactgatttagggtccaaaatgcttcctggtgagtgggatcccatcctcttagagtatcatccctaagcttacacttcagctctgtctttaatacaccatttcatcactctatctggctagcagtttcagggtagtatggcatgtaatcgaattccagatcatgtccccagtgttgccttcctttttctggaaagggaacctctgggtccaattcaatgttatataaaatcttgtctctgtatattgttggcaagattatataaaatcttgtcatagtcaaacactatgctcttgaccaacaactggctgaggacctccaggaaaataatcataactagaatttgtgtcaattgcagtcaaactgaattattgctccatccggttttgaagagactccatatttgtccccaagttgcttattggtttccttcaagaatggtgacatattggggactcaccattggcatcttttataggcaaggacaatagctaaatgagccttaatgtgtaggtagctatgctgttgtgcctacatataacctctaaccctgccactgtggaagggttgctggatttggcaaatacaggatttccagttacatttgaatttctgataaatgacaaacttcagcataaatatgcttcatgtgaggtcatgctgttcttgggctactcctagcccaggactgaatataacaggggtacaagagcatggatatgtctaccaattgcaataatacaagaaaacatgcaattaaagggagttctcagactggattactcaccaccatcttgagtagtatatggggcataggtagtacctggcacactgtgacagtccagatcctgaagatttcactgatggttacctgggaaaacatccccgttggggggaaaccccattgctgattcaggcatttgaaggctgtgaggggaacattgtatatacaacaagggtagagttggccagttattactagattgtactgatgctctacagagaaataaggagaaactgaggacatagtcaacaacagttaaaatttaaggaagagagtcagagggccatttgggaaacttacgaagaggactttatctccttcagtgggaaatcaggcatagatgaggatcaaatgcagaacttgagagttagatttgcaaatttgcagatatgaccagatgtccaaccaagccctatctattaggctaaaatgagggccctgttttgaaaagcctggaactccaaaacattgagtgagttcatctggatgtgtgctatcaaggattgaggctttgtagacttccctgaaccctctcaaagcctgtagaggtagtccacccctccctataagagttagcacttctcagtagtggaagaccttttggagactattctccatcaagataacaggtgtttgcttcaagagcaccccaacttcctttcctggctgttaagccaataatcggaatcaaatccagacaaggccgagcgtggtggctcacgcctgtaatcccaccactttgggaggccgagacgggcagatcacgaggtcaggagatcgagaccatcctggctaacacggtgaaaccccatctctactaaaaatacaaaaaattagccaggcgtggtggcgggtgcctgtagtcccagctactcgggaggctgaggcaggagaatggcgtgaacccagcaggccgggcttgcagtgagccaagatctcgccactgcactccaccctgggggacacagcgtgactgcatctcaaaaaaaaaaaaaaagaaacagacataatccgttaggacagtcctaggtctcataaaaagataaaagattacaccccggatgagctataagaattaactgccatgtactagaaggggtcggggggtagcacagggacttgttttgaggatcctttgttaagataactgagacataaaaatggataaacagaaatctattgacattggacagtttttcaagacatgagattgaaacctggcaagaaacccaagggatgggtcaaaaatctctgctacagtggctcctagaagcttgaagaaagtgatgatcaacgctgagtgaggtggaaatgcctgagttgcctcggcaaacagtattaaaaaaaaaagattcaaagactgagggaaatctgcatgctacaatatattgattggaactatcatctactaggtgaggcccaaagacaattacgttccatgagaggacccagagggcatgtaattccccaaaaccacgaggaatgcaaagaagcaccaacaccactaagaaatgaagtagttattctctgcaggccgggactgaccatagcagaaatattaccttggatggtgtcttggtctgtttgggctgctaaaacaaatgccatgaattgggtagcatataaacaacaaaaaatatttctcatagttctggaggattggacctccacaattaaggccctggcagattctgtgtctggtgagagcctgcttcctggtttacagacagtcatcttctcactgtgtcctgacatggctggagaagtgagggagctctctggagtatcttttataaggacactgattccattcgtgaagcctccaccctcataaccgaatcactccctaaaggtcccacttccaaatattctcacattaagagctatgatttcaacataagaatctgagggcaacaatcattcagtctacagtagatggctaatagcaatggggatgacagtgccctgaaggaatagagaccaagtagcagtgcttaaccaccagaaaccagggtctgttatgttaactagcaaagttggaagggcatccacagaaacttgacctacaggaagttgtagagatggtcaacaaagcaggtaagaacagattaatagtaaacaaaggtgttgcttaaaatctacactcaaaaggcaaggatgcaggatcagaaagctaaggctgatttctcaagttagaaaggcatgatgctttgctcagttattgcacctgagacaattttcagaactgtagcctactgacagaacaagcggctaggtctgaaggaggaagtacactgcaacaccgtggcaagtatatactgtgattatatccccactccttttccaatgggttttccatctatttactcaggtgattgtacacttgggagaggagggaacacccagacatttcaagaactattggatataggtctaaattaacaccgataccagaagactaaagcattattaggcttctctgttagagttgcaggcttatggaaatcaataaataaatttagtcctggctggagtacagttcttagtgggccaatcagattcacagacgcatccaaacatcctcccagttctggaatgcataattggatttgctgtacctggaagttggagtaaaccccacatcgagtttctgatcgttataagagcttctgtagtgggaaaagccaagtgaaaacctcttaaaataccttcctcctgccaagatagtaaatcaaacacaattttgcaaaccaaacacaggaaattaatgctacccttcaatatcctaaggatgttcctattgcatctccattttattcatcagtctggcccctgtagaaactggatggatcctggctaatgaagccagggcttcactaagtggtagttcagatcacagctgctgtgattgttgctagcaaatattgtcactagagtaggtacatggtatacaacagatttggcaagtgtgtgtttttccattctaattagaagagaggattaaaaacagtgggcaagataagaacatttacttacagtttttctaaaagctatgttaattctcacacctccagtcataatattgtcatacaagatttaggctgtcaggatatcatgaaaaacatcactttgatccattaccctgacaccatcattctgattggacaggacaggtaagaggtagcctgcacactggaggccttagtaagacatgtgcacaccagaggattggaagataaaggccatggggattcagagttctacatcggtgaagtttttaagggtccagtggtcaaaggcatgccaggatgtccccaccaaaggaaaagacaaatcactgcctcttgaatctcccactgcaaagaagaaagtagtgcacctggtagacctcttagggtttgtgggagaaaatgtcccgcccataagataacttctccagtccacacactgggtgacacggaaggctgagagttgtgagagaggctgggagcaagagagggatctgcagtaggtcctggctgcagtgcaagcaattcttggaccatctcatctgacagaccgtgcagtgtcagaggtgtcagtgataagaaaggaggcagggtagggtttaaggccattccccatgggaggatcgccatacagacccctagggttctggagaatggccatgccatccacgtaagacaattagcttccattgtgcttttgggccctgatagagacaatgcttgaccatgggacaccaagtgactgtgtgcctcctagctagttgctatcagaactaccaagtcataaagacatatccagtagtaatccttcctaaattgagcctgagcatcaccagaaggcaagagtcagtgccagagcagtagcccagacccctgtgttacagttgccccatagtgtggttactcatgttaaaagccagtagaggggaaaaatctccccagtgagtggagctgcaagcagtgcacctagtcacctggtcgttaactttgtgtagaaggagacgcagcccaggatgagaaaaaaatacacacatacacacacacacacacacacacacacacacacacacacacacacagcatatatgtatgtttgttaatgtgtatatatatatataaaatagtatacacatatatataatgaatagtgtacatattatacataataattagtgtgtctatgtatacacacacacacacacacaaattcattgaatggattctgagtttgaagaatggctcacatccagaaactaggcacggaatcatgactttttattgaagtgtccctcatctgcctcctgattatccattattttggtggtatagatggagcaacagccttggtatctgccactagaaaatttattttctaataattatcttcatagccctcttcaagtcagacctctggctgctactttgatgttgttgctcattctgatagttgtgctcaccttccttataacggttaatcaccatcacctggtctccattattaaagcatcctcttattgttaatagggaacccgattctgtaacagcatattttactggctaccttgaccttcagatacccatcactgaacttcttcatgttactggtacttacttatttacttactgctgtgctaaaccgagcatcctcctggctctcccacggccattccggtgggttttctggtctgatgcaggatatccactcttccacattaatttctctgagtgttttgatcccttcttccactgtcagtcttgacagttctggcattttaccttcacttagtgtggcccatcactttcctaatgcttctaagaaccatgtaaacagtacattaacactgtttcccaggggcctggccaggctgttacatcttttgttacaggagagtactcctatacctataatatctctcctatccaacgttatgctccacctccattgatccaacattctcagaacctagtcccatgcttaccgtcacagcttgatggtatatatttgctagatcttgtagctcctttggaaaacagtttgtctcatcttctagcaagtttagcacttctttgtccaggttatacagtaacttaatgctagttattgctctggtatatgggagggtgagtggaagcagaccttgagggggatacatattgtctataaaggtcacatggactttaagcaagcatggagtactgttttttaatagggagaaatggtcccctttgaaagcccctagaaggttcagagaagtttgggcaatcaagatgctagagtacatcaacttagatgttcttccttcttgtctcagggtaccaatcagggcactgacctttatgtagctgacctccagaaatttagaatttatcctgctcttctcataattacgccccgggtctcatagtcagcatttcctgcctaccttctggctgcaagtagagtttctatatgttgccaaggaggtcttctattttacacacaacctctaatgggtaactaatcaccctcagcctttgattgcctctctccaatatttttattgctcccagcaccgttcacccattctatttttcttgtatttaattcctctgcaattctcaaatacttgatattttgcatctgccatgcattctctaccatctcagttcatcactgagtaaatgttatcagttgcactgctatcttccaggaagaccgggtgcagttccagtccaagctgaaagactgaaaaccagaggagccaatgatgtacgttgcagtttgagtctgaaggccctagtaactatgggctgctggtataagtactggttcaagtccaaaggcctgaaaaccaggagcaccaatgtttgagggcagaagatggatgtcttagctcaggcagagagagtgtgtccttcctctacttttttgttctatttgaggtcttagccagattggaaaatgccagccctcattggagagggtgatcttctttattcagtctacctattcatatgctaaccttttctggaaaaaccctcacagacacacccagaaataacattttaccatctctctggatatcccttagcccagtcaagttgacacatacagttaactaactatcacaatctgttggtcatttgtaagtactttgactattcctcggagtgtgaaggctcctgatcagagaaatgttctaatctgacttagtttttaaaaggatcacccaagctacactgttaaaattagtctatgatattatctataaaactactgcaagagtctaggtgagagttcatgatggctgagaccagggtaaagaagaaaaatgatgggaatattgttagggtttagcgaataatattcctgtatgaagtggataaaattcttgcaagtgagacttttctctccctccagtgaattgtttcaattctcagtctttgcacaaaggagcacacctggagttccaaatcagaaagggaatccaaggggtcctgtacctcttgatttataaatttgaaaacataagatctaagaatggatactgaaactgatgtttgctttatcctgtggggcacattcaatctcgtgcagcttacacactcttagtttgagctcaataaccatgtggcatgttttttgtttgcttgtttttggtttatttgtttgtttgtttttttttgtgacagagtcttgctctgtcgcccaggctggagtgcagtggcacgatctcggctcactgcaaactccgcctcccaggttcacgccaccatgtggcatgtttaattctttgataaatgcagttttgccttggccccagtgaagctgatagggacctgaagtaaggtcagacaagtaaaatcctcagacagaggattactctaattcccactggagtaaatataaactcatgagggaaaatgcagcgttatgacttctccaaggtcaaatatacatgtctcaagtaaagcacttgaaattgggggaaaaattcataaaagggacaaaaagtgtggtccgaagcacatgatagtcccatgttgcatttcaaaaaagttgtaatcagtccagcacggaccccagcacggtggtagtaacaaagtagatgctttgtaagccaaaaggatggacttctaaaagctttatgagctagtctaaaagtaaaataattgcctcaaaattggagacccagtgtggtatgtatttcaaatctgttttatattttaataactgaataatagcagcctacgggaaggtcagttaggtgtttcttatttttatcactaaatctgactgacaacaagggaaatactagcagccatccatgtggtagtcaaaatttaaatccagtctgttaggggcaatacagtattaatgccatgccaggaaatattggcccttcataagaaaagcaattatgttctatttttatacttagattagatcccagttcaagagaatgtaagaaaagaggcaaacattttaggtagtagcccacagaaattaaagatgatataaacaaatggaaaaacattcaatgctcacagatagagataatcaatattgttaaaatggccataccccccaaagcaatttacagattcaatgttattcctatcaaactatcaatggcgtgcttcacagaattagaaaaaaaaaaactcttttaaaattcatgtggaaccaaaaaatgagctcaaatagccaaggcaatcctcggcaaaaagaacaaagctgagcacaacatagtactcgacttcaaaatatacaaggccacagtaaccaaaacattgtggcactggtacaaaaacagacatgcagaaaaatggaacataagagagagcccagaaataatgccacatacctacaaccatctgctcttcaacaaagatgacaaaaacaagcaatcgggaaaggaattccttttcaataagatggtactgggataactggatagccatatgcagaagattgaaacttgacccgttccttacaccatattcaaaaatcaactcaagacggattaaagacttcagtgtaaaacctaaaactataaaatccctggaagataacctggaaaatagcattaccaacataggaatgtgcaaaggcttcttgacgaagacaccaaaagcaattgtaaccaaaacaaaaattaacaaatgggacctaactaaactaaagagcttgtacacagcaaatgaaactatcaacagagtaaacagataacctacagaatgggaaaaatatttgcaaaatacgcgtccaacaaaggtcaaatatccagaatctataaagaacttaaatttacaagcaaaagcaaacagccccattaaaaagtggccaaaagtcattaacagactcttttcaaaagaagacatacatgcagccaacaagaatatgaaaaaatgttcaacatcactcatcattagagcaatgcaaatcaaaaccacaatgagataccttctcataccagtcagaatggtgattaataaaaagtcaaaaaataacagttatggtaagatttcagggaaaagggaacacttatactgttggtgggaatataaattagtcaagctgctgtggaaagcagcttggcaatttctgaaataacttaaagcagaattaccattcaacccggcaatctcattattgggtatgtacctaaaggaacagaaattattctgccataaagacacatgtacgtgcatgttcatagaaacactattcacagtagcaaagacatggaatgaaccggtctatcaatagtagactggataaagaaaacatggtagatatacaccatggaatactatgtagccctaaaaaagaaggagatcatgtcctttgcagcaacatggatgcagctaggggccatcatcctaagcaaactaacacaggaacagaaaaccaaatacttcatgttctcacttataagtgggagttaacttcgtgtgtatatggacgcaaagaagggaacagcagacaccaggacctgcttgagggtggagggtggaagagggtgaggatggaaaaactacctatccggtactatgcttatatcctgggtgacaaaataatctgtacactaaactcctgtgacatgcaatttacctatataacaaacctgcatgtgtatccctgaatctaaaataaaagttaaagaaaaaagttcatagaaggaagagtaatcatgagagtaagttttggggaagtctgggaaaagggttctggccttaggactctgcagagttttgctaattaaaaactgaagaggagaaaacttcttcttgcatgacagtatgaggaactctgcagacccactgccaagtgaaactagtaaaaactatttaaaaacaaccttttaaagtctctgtaaatggtgataaggatgggcagcaattgaataaatacctattcaaatcatctacaaatattctatagattatcatcaggtattcgttttcctatgcctactttaacaagctaccacaactttggtagcttaaaagaaatttattctctcacagttctggaggttagaagtctgaaatcagcatcactgagccaaaatctagcagggttgtgctctctccagaggctgttctttgcctcttccacctggcaaccagcattccttggcatgtagctgtatcactccaatctctgcctccatgatcacattgcttttttctcttttgtctgtgtcaaatctctttctgccactctctcatacagacctataaagtaaattgtcatataaggtaatattcagaggttacagggattaggaggtggatatcttttggggaggctattactcagtctatcatccttcaaaaaagaaataattagatggacagctcaattctcaacagaaactatagaagacacaatacaatagtatgatgtgctcaaagcacagaaaaaatatagctgctgatttagaattctatacccagaaaaaaatatgcttcaataaagaagatgagtaatattccattgcacgtgtgtatgtgtgcgtatcacattttctttatttacccatttgttgattgatacctaagttgtttccatatcttggctaccacagtagccaagataatgctgcaatgaacatagaagtgcagatatctctttgagatagtgattttatttcctttagatcgatacccagtgcaggattgtcagatcatatgtttgttctatttttaatttttttaatggaacttccatactgtttttaataatgctatacaaatttacatttctgccaatagtgtacaaagctatagtgatcaagatggtgtggttttagctaagagacagagacatagattaataaaaccagatagagttcagaaccagactcacataaatacagcccagcaatttttacaaaagactaaggctattcaattgagaaatattggcttttcaataagtgctattggaacgattagacatgttttgttaaaaattgaaactctacctaaacctcacactttaaacaaaaactaactcaaaatgcattatctagatgttaaatgaaaaactataaaagttttaaaagaaaacatggagtcaagtcttcatgacctagagttaggcaaaaaggtcttaaacatgacaccaaaagaatgactcataaaagaaaaaaagataaattaaacttcctcgaaacgaaaaacgtttgctttgagaaagaataaaaagtcaagctacaaactggaaacatttttgccaatcatatatctaataatggtcttacacacggccgggcgcggtggctcacgcctgtaatcccagcactttgggaggccgaggcgggtggatcatgaggtcaagagatggacaccatcctggctaacacagtgaaaccccgtctctactaaaaatacaaaaaaattagccgggcgtggtggtgggcgcctgtagtcccagctactcgggagggtgaggcaggagaatggcgtgaacccgggaggcagagcttgcagtgagccgagatcgccccactgcactccagcctgggctacagagcgagactccgtctcaaaaaaaaaaaaaaaaaaaaaaagtcttacgcgcaaattacatgaagagctctcaaaactccaatatgataaaataacaacacaatattttaattgccaaaagataacgatacatacttcacccaaagcagacatgtggatggccagtaagcacatggaaaattgttctacatctttagcaatagtgaaatgcaaattaaatgcatacatttgagagagaataaaattcaaacaaatttttaagttaaaaacagcattacaaaatgatagcaataatgaacaactttgactcttatacattattagtgggaatgtaaaatggtacagcagatgtggaacatgattgggtaattactcataaacatacacttactgtatgactcagaaatgccacacctgagagaaataaaaacatatgttcacacaaaatcctacacatcaatttttatataagctgcattcatatttgccaaaatgtggaaacaatgcaaatgtccttccacagtgatggataatctgtgttgcatccatacaatggattactattgaataataagaaggaatgaactgctgatatacacaacaacctggataaacctcaaatataatgtgctaagtgaaagacaccagtctcagcaagttacattctctattctcccatttatatgactttgtccaaaaagcgaaactatagtgatggagaacagatgagtggttgtcaaggttatgtgtgaagggaaaggagtttttcattttgaggaagtctaatttatctttttttcttttataaatgaatagcacgtgaaatttttttgcagagggcgatgaaacagttccacattctccttgtggttgtggttacacaaatctgtacatgtgttaaagcctaaaactgtacatacagcaaaagggaaaaaaagagttttatcatttgacaatttaaaaaaataaaataagaaaatgagaaaactgtagttaacaatattaacatcagaaattcttgctttcataagaaggaaagttactttgaataaacagggacattacataatgataaaagattcaattcaccaagaatatagcaataccaaaggtgtgaacctaaaagcagagcctccagataaatgaaacaaaaactgataggactaaaatgatagccaaatctacaattatatttggggatttttatactcatcagtgagtaaataataaagtaaacagaacatttctgagtacgaaagaactgtaatgacactattaacaaacttaatctaatttgcacatgcaaaccaccacacacaacatggaaatataaattacactcaagcacacatggaatattcaccaagaggagccataaaacacctcttaaaaatttaaaagaattgaaatcatgcaaagtatgtattatattttgaatgtgtcccccaaaagcatttgttggaaacttaatccccaatgtaaaaatgttgggatatgggacctaatgagagtgtttaggtcatgaggtctccactctcatgaatggattaatgcagattatgaaagaccttgaggctgtgagtttaatcccttgttctccctcaccctttcttttcgtccttctgccacgggatgacacaataggaaggccttcaccagatggtggactcctcaatcttggactttccagcctccagaactgtgatccaataatttctgttcattataaagtacccagtctgtggtactctgttatagtagcacaaaagaggctaggacagtatgctctttaattacaatgaaataacactgaagaatataacaaaagaaatatctgtaaagtcctcaaatatttgcaaattatataacacatttttataacccatgtttcagaagaaacaattcagggaaattagaaaatattttcaattaagttaaaattgcaacatgagaatttgtgagattcagccaaactcatgcttaaagggaactttatatcattacatgttcatattagagagaaagaaagagatctaagcaataatctaagctttctcccttaagaaactatataaagaaaagtaaaacaaatctaaggcaaggagagagatggggataatatagataagagcagatactaataaaattaaaattggaaaaacaatgactaatatcaatgtaaccaaattctgactctttgaaaagaccagagaagctgaaatacccagtgtcagaatgataaatatttgaaacaggattgttgagaagccatggctaaagagtacagctaaaagcctaggaaactctacatatagagtgagggatatatgatacaagagttttaagaaagggcaaaaatgaccttaaaattaacaaatctcttatgatctagtagtaatgtttaattgtttaaaagtgtggagtagcccacaaatcatttaaatatacagcaaaagcatataaagaaaacaaggtgagaacacggaaaaataagaaagcatttttatattgtaaggggaaaaatactgcctgaatataaaatggtgttagcaagaaaatgtattagcaaagatactagtgtttactcatttcattttttttgagaacgtgaactcatattttaaaagaagaaaaaataaaaatactatgagattattccattgcaaagcaataaattatgtgcatatattttatatctgaaaatctatagacatacatttggatcaaaataatttggtaaaattcagagatttatgagttttaggaaaaaagctatggaacaaaaagtaaaggaagtactcacaggaagaaaaagggtgtgtattccttctacaagggaaaaaaagaaacaaacaatatggcgctgagaaaattctgaggccccaacacaatacagaatcatatcagtgtgagagaccgctaatggcttggttaggacagtgtgggcatgaaaacattaaaatggagaaactgtgattacagaaaataaatatgtgggatgagcacataacacttccagtacagaagaaatattaataaaatcataaattacagttatttttacatggtattgactttgtgaaagacaatcatgtattaactgaagaagccgtgatgtgtaatcacctgtggagaaaattgttgatcattattctgaaaatcttgcatcattcttattaaaataaagaaatgttgcatcattcttatcaaaataaagaaatgtttaaagaaaagtgcattttcagacattgcttggaattagtgacaataatgactgaagcactttttaaaaaacataatttgtttattgtgagcttagagaagagacatgaataacattcataataatgaatataaccataataattccttctgccaagactgcctatacacagtcctttatataaatactggattcaaacatgccatgtagaatatgatttaaatataaatataattttcctttaaaatataagttaacttttctagagggaggactttaaaaacaaggtagtttcttacctctttagcattgtatttgaaagtgtgaaagaaactgggtgacaacatatagcctactaattttatttcaaattatttgtttctttctggttacaaagatggtaagcatatcagaggctgaataaaagaatcaagcaagaggttaatcaatattggaaacaagccaactaaagaatatatgtttatttttggtagtctaaatcatcttttaaaatatttataatattttataattatcaaggtaattcatgtgtttcagatgtgttggaaaatattgaaggcataaataagaaaataaataaatcaattacatttcccctagcaagaaaagaacattgttgctattttgctgtatattctcccagttccacgtaagtctataagaacacatatgggtgtcccatagtcttccaatcctgctttgtaatttaagtaagtttgaaatattggcatctctgtcatgcaaagataggttttaaatttggagcacagagcttctgcttctggccaagattaagtaataaggaccaaaattatacatatgcttacaacaactagaacccagacaaaatatatgaaacaacacttttcaatttattggacataggcaacaaaggttagttatttctgatagatgaaaaacaaaaaaggaaagtcctgcaattgtacccagcgtattgcctgaagacagattgcaaatggcagtgcacaaagcaggagcctgattgtatccttcagctgaggatctggagcaggcagtccagaaaggccaaagtggctggaggtttcagtgcaaaatactggaaaagagaaaggtacacagggagatctcctgaactcacagaaagcttgacataattcccattcccaacaggtaaagtacagtatctcacaattgacagggcattggttagagcactcagaatggttttgtcttagtaatgaagaaataccgaccatagacaaaacactgctctgatctcacataacaaattaaagcatggcccaatagaatcatactatttccaagaaacttaactatggcccagaaaaaatctcaagaatatttatttatagacacacaaaaatacccagcacacatcaaggtaaatttcacaatgtctagcatccaatcaaaattgccaggcattcaaaaagaaggatagtaggatgaatgatatcaagaaaaatcaattgataatactaacatacaaatgagacagatgacatagtagataaggataataaaaacacttattaaaactgaattatatatgttcaagaaattagaggaaaaattaagcaggtaaaatagagacatagacaatattttaaaaactaaatcatctttgacatatgaacactataatgtctgagttgaaaaaatataacagtgtggattaataggggtcaagtcataaaagaagaaaagattagtgaacttgaagatacagtgatagaaactctccagaatagaaacagaaagaaaaaacacaggaaataatgagtagaccatcagtgagctatgaggcaacttcaaatggcctaatatggatgcattgggagacctcccaaaggagaggaaatatggaggataaaaatcatttgaagaaataatgaaaattatccaaatttgatgaaaaccataaatctacagaggcaagaaaataaaagaatcccaagaacaggaaatatgaagaaaactgtacagcacctcataataaaattgcttaaaaccagtgataaagggaaaatcttaaaagtagaaagaggcaaaaaaggtattttacctacatatggatgaagataaagacaacagcatatttcttgtcaaaaacaatgaaagccagagaaaagcagaacaatatccttaaagcactgaaagaaaaatagtgaacctaaaatccacaatgtctgacattcactggcatcccagggaaaatacgtttcaaatcaaagatgaaataaagtatttttcagaatcaatcaccaacagaaatgcagtacaggaaatgttaaagaaagtcctccaggtaggcagaaaatgataccaatagaaatctggactaacacaaaggaatgaagagcatcaagatttgcaactttatggataaatataatttctctattatgtaaatgtctttaaaatgactgtttaaagcaaaaaacgtactgtattgtgaagtatataacacatgtaggaataaaatgtgtctcaacaatagatgaaaagctaagaagggagaaatggaagtaaattgttggttttcatgtgtttgactattctgagttccagtggtcagcttgcttcctttttgtacccaaggccctagcacagtagccaggtgggcctatatatgtcaggcgtttaaataccactcatcatttaaagtgtgaacacagtgtcactggagggaatctgtgaactccacacccaaattactcttctctgttaaataaggaactcataggaatcccttcatcttgtgttcttgaagggaattaagctatacatctttaatagactttagttgagattaggcaatctgaatatcagtaaagatgattatgtgctgtgttgggggagcagaggcaacatacataagtaaaacgtaccaagctctttgctcttgtttaggacggttgaacgtgatctgagaatactttcaaaagaaagtaaaaatgcccggctgggtgcggtggctcacgcctctaatcccagcactttgggaggccgaggcaggcggatcacgaggtcaggagatggagaccatcctggctaacatggtgaaaccctgtctctactaaaaatacaaaaaaaaccaaacaaaattagctaggcgtggtggtgggcgcctgtagtcccagctactcaggaggctgaggcaggagaatggcgtgaacctgggaggcagagcttgcagtgagcaaaggggaatggtgagttggagggaggggagtgagtcccatgctgacaataaaaaatacatgagtgagcaggaggacagtgtgtatctatgtgggtttaggtcaggggatggggtggggggacacaatgaggagcctgggaaaccagaaatggaattgtagcatatacagagaatggagagtttgggaggtcacaagtttttggcagtgcctggcaacaaagttgagattctgtgtggcagacagaatggcatccacacagatagatgcctgtgtgagggcatgagaaagtccgtgtctgggaagggccttttgcacagaactgctccagtagtgctcaggggtgtcagggcccaatgctctgagggaaaaaaaggtgctgggtagacaggactatgggatgagtcctcgcttcatccacactgctctgtcttcctcatgttcatggactggagttctgtggaaggcttctgttggagtaagagtttccacatctaaaattttgacaaccactttccaccaactagatacaaaatacatcatgaagtactgacccccaggtacttcgactccagattgcttcttgccccttgttctgtttgtcatgataatctttatttagttatggtagagctgccagctgccaaaaacagcacactcttataggagataagtgtctgggtattagtagttatacacttaatcttggacaacagatgccaagagcactaaaagtaacataatatagcatatatgacattgaaaatggatgatatataaatctggccaggcacagtggctcatgcctataatccaggcattttgggaggctaaggtgggcagatcacctgaggttgggagtttgaaaccagcctggagaacatggcaaaaccctgtctccaccaaaaatacaaaaatttgctgggcatggtggcacatgcctgtaatcccagctactcaggaggctgaggcatgagaatctcttgaacccgggaggaggaggttgcagagggctgagatcgtgccattgagtctggacaagagaaactgtgtctcaaaaaaaaggatgatatataaatctatatacaacatgagacagctgaaacatatatacaactatatattgacacaaatgcatatgcacatatacccatatgcccatatacccgtatgggcatatacacataagtagttgcatatacacatatgcaactatatatattcacacaaatgcatatacacatatgtatttttatacaaatatacatgtttatatacaaatatacatgtttatatatatacaaatatacatgtttatatacatgtttacacatgtatataacaaatatacatatatgtatatgtatatatgtttatatatgcatatataacaaatatacatgtttatatgtgtatatgcaaatatatacatatatttgtacatatacacacgtgtatacatgaagatatacatatatctttgtatatatgtatatatacacaaatatgtatatacacaaatgtatacacacatatataggaaacattccctatttggatttctggaagtgttctctctccctttcaagcctcctgtacgcttccttcctttattaaactttgtgtaactttggttaccaaataaatgtgtttgcaagaaatggaatggcgtcatgtagcatgtaagccagtatctacacaataatcacttgattttacttaagcctatagcctcaaattacttctcgtgatgcagccaacctaatatccagtcttggccccaaccagatagacagacccctttctctactgcctacttgatagcaccacctggacaggctacagtacctccctgactacatagtgcacacggacctcatctccacactcttccccaccaaaacaacaccaactcttcctcctgcaccttactctcaactaaaggaatagcatcacctaggcacaacctcagaagtcagatcaatagcaattctctccatcagttcacagtccctcacttcctaaaacgctcacatgtctttccacctcaccatcttctccacacccctcacagaatgaattaaggggcttgccactttcttttgtattgttgacttggtgtgtcctcagcatgtgttcaataaatgtttgctggatgaacaaatgaatgaatgaatgaaattaccaggcaaggcatcaatgaaatcactgatttaaatttcagagcctgaccccacctaggcctcctgcctccatgaggaaacatacacttccctcacctatgattgcttgagttcaaaatttccatggaaactaccactgagagggtcactgtggatgcctccttcccaggcccaaacaccatcatggagatgaggatgctcccaacaggatggtgcatgatgcttcatgcattggaccctgtacatccctgtcagtttaacaagggattgtgccatctctactgagtttccatccaacctgcccatgtccacaccttgggccagccctctaccctagacagtgtctggaggcaaaataggcaagcggtcacagcttcaggacacctgccccttgtggtccaagagctcagaagacacaggaagccatctgagacatgttcaccacctggatcgctttcactgcacttccccacacagtgcttcatgtgcagagtctgagcagactagtcccgcggcactcttcctccgactttccctccatgcagccacactgccaccttcaactgcattcctggcccatcttggctttcggtcatcagtcaccaacccattcacatagcccagctttggtgaagggtccccaggggataaaacaccagcccccagcaggcatgaagacagctcccagccctggaatgctgcagactttgcacaggaccactggaatcgtcaagagaggcagcttgcccagaaagatgcaggaagccagccatatgcttcctgacagagggaaggaaattctgagggagggtgtggtgtcctgcacgcggctgatgcattcagccaaaaggcctgcacattcagatcacagggcccagtccaattggtgatgatggtgcccgatttcccaaatctaatcctgttggttgtcctgttctccctcttcccttcccacttttcttcctcaggttcctgaccccactgggctgaactctggattcagagcactgagtaccagcctgcctggggctctgtggacttggtttcacatgtggtctctctcatacaccctggcaattgctctcccctggatcctcccaatgaccctcatgggctgagggtgtcctccctgctccacttccctggctcctgttaagtctgaccaaaatccttctcaaagcaaagtagaaatgtcctgtccacatttcagaattttaaataatctgtgatttttattagaatgtgaattggtacagcattttttgtaatgaaattaaaaaatatttataaaatgttaaactatttacaaccttttcattttaacccaatgtccatgttaatacatttcttataagaaaacattcatgtttgctcaataattcatattcaaagatattgattttattcggtttatcatacaccaaatggtaaataatgtgtttactaggaagaaagagtttaattaattatggtgcatgcgtacttcagaattatagaaagtggtatcaaaagagagatagatgtatatatgtgctgttgtggaaagatcccatatccattttatgaagggacaaacactagtggcagatcaatatgtacatcattattgtcttatattaaataaaaataatatattgttaaagtttatgtgtcagtgaagagcctagggtcagctttaaaataatacacaccagatggttaattgtgggacctctgaggagggggctaaaccgtggaagagctttgcaaactttaaaattgtaaattatctacatttctataatttttgcaataagaatatacaaactattactttttaaataaaaaatatttacatctaacagcagaaatagcagctgtgtcagttaaagtaactgctagctgatgcaacagacaaaccctgacatttcaatggcttgacacaacagaagtttattttatgcacacctaagttctgatgtggcttggcagaggttctccactcccacgtgacctggggatccatattacttccaccttgtgattccatcatctcaagctgaagctgccatgtttgccattgaaaggagggagaaagaatggaaatggcacattggctctcacatgccgggatgtgacagacaacgcttctgctcatgtttcagtggtgaggagtcgtcacactactcttcctaactgcaggtgaactgtgctgttcctttgtcaaggaaagagaggaagacaaggtgtgggtgagtactgtagtctcccccataaactgttacaaagtgcttaataaaaggcaactattcatattataattcggtgttacacgatccagctcatttctaggaggagtttctgagaaggtcaaatttgccttgaagttctccagattgttcaagtgcctaatatgtgactgatactttcaaatgtaggatcacaactgtccagaatcttgaaagtctcagcaggaaggcctccctttgcaatgccctttattttttttaacttttattttaggtttgggggtacatgtgaaggtctgtcacatacataaataagagtcacaggagtttgttgtatatattatttcatcatccaggtattaagcccagtacccaatagatatcttttctgatcctctccctcctgccaccctccctacctcaagtagacttcagtgtctgttatttccttatttgtgttcataagttcttctcatttagctccaagtacaccgaaaatattttcttccatttgattcctggttaaaatcttaacctgtgagtctctgctaccctccacatgcctgaacacctgtcgggtgcctctaggcacactgaaagccagtatttttccatggggcagttaagcatccaagaggcagtagaaggctgcttaattattcctttttcatcggagctgacatgtattccaaggaatcatttttcacctcctgggagactataggcatttaggaattcagcctcagtatgtagatgtttgttccactaggattttcaaagtttttccccacctaatactcatgagggaggctttggttttaaagcattcatctgtgtatgtgttcagagctggattccaaataaaacacccggttaaagtctaatttcaagtatcaaggtggttccaaacccctattaacttcggggtgacatgccaaaaactgatggataatatggcaaatcagactctactcaacccattcggaaaacacttggagactgtgttgaagataaccagagtggtacccagttgtctaaaagccactgtccctatgtgaattttatatcaaaaagtttgcttattatcacacggcttcctgggtgagagatgggacagccagaagacttctactgtcccagaatgctccctgtcaagaggtgagcaggtgattttgggctgttctgtggggaccagtgacaaggtggtcagcagggaaggttccagagtcagacaggaccatatggaagtgaccagaggaaatgcgctgtagttccagaaagtgctgagaccggacagaaatgcccacacctggggagactcagctgtcaaggaacccagcgcaaaccagccccgaatggtgtttgattctcattgccaccttctccaagcctgcttttagtaatgttggcctcaaggtccttctttttgtcacctgagagacatggtgcagtgctgagaagagaaataaagtaccagtcgggaggtcaacctcaggctggggggaatgggaacagcatgggctctaaaggaattcagagcaggagtctgattccagccctgttccttactagacacatgatcctggggataccccggaaatactctgttattatgtccaagttcacaagccctgtgagccttgaattcttcatctgtaagcagatttgataagccctgtctagtaggactgttggagtgtgtgcaatgtacgtgaagcacctggctcagggaatggaattaaattggaagtttaaggaaaggcagatggctgttacttctagtattatttgaccccagaccctagcattctgggattttgttgctgttgttgatcagagaatatacagctcaatagggcatggaataattagccaaaaaaggaagtttcgtccataaaattcagtaagaattaccacttagagaatgtgcctcaaaatttgagtgtgtgggagttttccccagccagatgcagctcaaagctcctagaatttgagtcaaagaccaactccttccctcgctcccagctgcttttccatccataccactattttcattttgttaccacccaaaatctagcccctgcttacaattggtcaaattgcacttgagataacctaattagaatgcctttttaatagtcagttctggttctcccagccaggtagaaaagcacctggccagtggcttctgggtctcccttttgggggagacatacacttatctcacaggaaacccttgcaaataacgggtgtccatcacctagctcatgcactgtgttcaacaacactgggacaaaagcgcaagacaccttccattcctgccccaggtagaggctcctctctgttcatccattgtcacaaaggaaccgctcagagcacttttccaatctgggcttttccctctccctctgagaatctggccctggacccaccaagcttcattagaatcagatccctcagaagaaaatggagtttcccaaagcccaaaaggccccacacagggaatttacacccgaccactctcacctggagccccatacccacactcgttacttttcccctacatcttagaggacatcttgtcaccttaattatatgaccgcgctcctagactcttaataccctatcggtaggtgtgtgtctggcttaccctagtatctccactactaatcctgggccttccacagagcagatgctcagtgcatagagaagaaatgagccagttaacagaaagaattatttattcagatttaatttctcttacattcacgaagccaaggaaatccaggtatgcatatatattttttaaattttacagaatagactgaggcataaggcgggaattaagtatcttttaatttatctcacctatttcacggtgaattcacacttctaaatacttactccactgctgttattatgtcccaaattcacaaaatagaacggatttcccaatctgaataaaaaacaagactcttactcctaaactatattaacagcaatatacgttaactacgattcataaacttggatgctgaagttaattcaaccatccattaaaaggaacatttcaacaattgtaaaaggaaacagagataaatctccaagtcatccaacaaaatagaaacccactactaagaacactgactattttcttcaaacagagtgaagaatgggcctcatgttacacgaggcaagggaagctgctgcacagggctgttagatgcactggcccagccctgccccttccccacagccctggctgcaactcatgctcagactccctcttcctcctctaacaaagctgcttcacgcagggatgggtaggcaatgcgaactcttgcattgaccctgaccacatgctccaggactttcacatagctggtttcagccagagcccttggaccccacaggaactcatagcgcgcaggattactgccgggtacctgccggtactccaggtagttttcctgcacccaatcttgggtgagcagtttcctgggctccccatagacagtgtgctccctcccatcatacacccccatcacacccagctcctcccagatttcctcctcagaggcgctgtcgccctccattgcaattgtgcccaggacgattatcagaaggcctgtcttgggaaagatctgattattacccagcaggccatcataggaaaggcccaggcaggtgacaagggtgtaggtgttgctggcggggtccacttccttcacgtcaatgccaaagatcatcttcagggactcggaggctttgccgaagatcacaggaaagcagcgcttgtaatttttgatgactctctccagcatttctgcctttgtgaccagctccttggctcgatacttgcggagcagaaaatgagccaactcatccaccttgttactgagtgcttctcggaacaaggactctgcgtcaggcgaggtgcttggcccctcctcttcttggctgctggaaccctcattgggttgcctccagcaagtgaagctgatggtagtgggtaaggcagaggctccctgaggactctggggaggacctgctgactcagcagcaggcacttcctccagggtgccagggaccagaggagaggaggaggagacagcagcctcctgctcctcagtagtaggagcctgtgcacccaccaggcccagggcctcttcttgggcctcaacgccttcctcaggcttgcagtgctgactcttctgctcagaagacatgatgactctggtcagggcagcaggcaagagtgcaggcaaaagctgggcaatggggacccacaggcctacggagagagggagcatgtgagagacctcagctgagaaccaaatcttagaggctctaacaaaggcttacttacagatcttctccttggtgctcctctgtggcctccagggaatcctgtcctccggttggcctgtctgctcagaacctgaaggaggaagtgagagagcacctcagggtatagccggccagcagaggtcgattctgcaggattgatggtagggaggtgaggccagactctttggagtcctatgtgtcttgtggcaggtggggcccttggtgtgcattcagggcaaacattcactgctggcacagcctgtgcatcctctgctctgtaacctgaggacactgtctcagaccaaggcctcactgccttgttcctggagctcctaggagaggaatccatgggcccttagggtgcagactgtaagcacagccccggtccctcagtgccatcaagagggtaggctggactctgtgaggtccccactctcatggagtggatgatccccactgtgttcactcagggccctcacatttctccaggcagggcctggatcccactcttttgctggcctgagaaactcagatcaagagctcacatgcctgagagggaacaggacctaagaaaccccacatctggccacctgtgcctaggtcttccgaagaacgacagcaaaagatgtcgaaattcattggaacccatgtgtcctggatgcggagcctgcttggtcctcacctcaactcctggcagagcctgggaccctccctctactgacctgggtgcagccccctcagaccaaggcctcccactccgtgacaccagtgatcccaggataagagagggacctcagcagaaagccaagcccatgctctctggggtgacaacaggagcagggctgatttctgtggggtcatcatctgcgttctggccctgtggtaccctcaatcctccctcacattcctcaccaggactcttggcagatcctgggaccactgtgtctgtagaccagatgggggtccctgtggtgacctgagtcaccctctgagaacaaggtcctcacctcactgagatctggaatcagaaatgagaaggagccacatcctgtcacccctgtgtggggtgcccagggctgacccctttggttctggggtgagggttctgatggcctcctgtggggtactcatgtttgctcctgacagggcctgcccttcctcaacccccaaccccctgagatgagcaaacattgcccctttactccaaaacctcatctccctgaaggttccccaacttcctgcctgtggaacaagtgaaattggcacatagggccatccctcctctggtcccccctgagctaagaacaggggacagccagactctgtggggtcccgtctttctgagccacaggtatccccattcctcgtgaagtgtggcacaccttgggtcctgtagatcctgggactcctccctctgcggacctgaagtaccacccctcagaccatagccctctcctctctgtgacctcgaagatgcaggaagtatgagctacaggtggctaccttgcccaggacctcccagggcccaggtctccactgatctggaatgcaaggccccctgaatcctccctcgtcttcctttccttgatcctggaagggcttggaacccacccctctgctgacctgagttgccatcccttggattcctgaggctaaaagaggaggcacctcattctcagacggggtggggtgggctccctgccttggggtgctgggtctcctgaggccttcctcatctcccaggagggccagggtcctccctctgctaccctgaggctctgctcatgataccaaaccctctccctccttcagccctcgatgtggatgtcaagatccgagtgcctgaccattcccaggtcttcccggggttgactgcaggggaaaaaatggattctgcaaaacggagttggggatggggctgggcatgttggaatgcggatggggtgggggtgtagcgccctcagttccctctcaaggtcctgaccccgatgccaggcagagcctgggccctgccttgggcacaccaagctcttgactctagagtcccctgtagctttagtggcagtgggagctgggatggcctagcctgagaagtcttcccccgggtggtccaggactggcagcaggagctgcgctggattatttgggttcctctatcttgggtgggggcctcctcagtccttcctcagagtctcaccttgcctcgccacagagcttgggcccgctcccctcagccgatctcaactggcccctcaggactatgcccttgattctctgacccccaaaaaacatcccagcaccaagcctggggtttccctggattgatagcagaaggggaactggattctgcctggtgagggtggagggcaaggaatgggaaatggagcagcgaaatggcagcggatttgtgggagtgggggttagactaggatcttgggggacctcagttccctctcaggtttctgactttgattcctggcagggcctgggccatgccctctcctaaccagcccttccctgatcacaccaacctctgactccagagtcccctgtggcttaaacaaacgcgttgcgaagggggcggaggtggggagcagcccagtctgagaagtcagcctccgcggggtagtccagggctgggaccctctatcagggataggggtttcctgaatcctccctcagagtctcactttgcctcttcacaaagcctgggccaccttccctctgccgatctcaagccacccttcagacccagaaactcacttctctctaaccctcaattcacaagtcagtggcatcacatccggccacccagggcttgcctggattgaaagcaggggtggaaccggatgctgcgctgatggggatgaaggtaggggtgggggaggggggtatgaggctggttggggggttggggaggataggggcacaggtggggaatgggggtacagatggggtagggagtgcagatgggaaaggggtaggggataggaatgggggtgggggacactcagccctctcctagggtcctgacgttgatgcctggcagagcctacccccaccagtcctgcactgatcacaccaagctctgactccatagtcccctgcggcttcagcggcagtggggtggtgggcgtcccagactcagaagtccgcccacgggtggcccaggactggaagcaggaggggtgccggattatttggggtcgtctatctggggtggagagggcctcccgacttctccctcagcttctcactatgccacctcacagagcctggaccggcttccctctgccaatcccaagctgcctgtcagactgagaagctagcgtctctctaacccccaatgcacaagtcactggcatcacatccaggaacctggagcttccctgggttgaaagcagaaacggaatgcgattcaacctggatggggatagtggtgttggggtgggggatgaggacataagggtagtgggggtttggggaggataggggtgctggtgggggatagggtgtagatggggttgggagtgtggatgggaatgggaagggggatgggaatgggggtgggggaccctcggccctctcttacagtcctgaggttgatgcctggcagagcctgccctcaccagtcttgcactgatcaccccaagctctgactgcagagtcccgtgcgacttcagaggcagtggggtggtgggcgccccagactcagaagtccccccacgagtggcccagggctgggagcatgagtggttcgggattatttgggattgtctatctgcggtgggggcctcctgagtcctccctcagcgtctcaccttgactcctcacagggcctggcccgcttccctccaccagtcccaagctgctggtcagacagagcagctcgcttttctctaacccccaatgcgcaagtcagtggcatcacattccggcacctgcggctttcttgggttgaaagcggaagcagaacccgattcagcgtggatgggggtgggaggagtgaggtcggtggagggggcgcgttttgggggtgggttgaaagcggaagcagaacctgattcagtgtggatgggggtgggagaggtgaggttggtggaggggcccgggttttggggtgggagatggtggtgtgagagaggtgcggggttgaggaggataggagcctggtgggggatgggggcgcggatgggtttgggagtgcaaatagtaatgggaaaggggagggggtgggggatgggaatgggggtggggtacgcttagccctctcttagggtcctgaggttgatgcctcgtagagcctgccctcactagtcttacactaaccaccccaagctcggactccagagtcccatgtgacttcagacgcagtggggtggagggcgccccagactcagaagtcagcccacgggtggcccacggctggtagcaggagtggtgcgggattatttggggtcgtctatctggggtgggggcctcctgagtcctccctcagcgtctcaccttgactcctcacagggcctggcccgcttccctccaccaatcccaagcggctggtcacagagcagctcgcttctctctaaccccgaatgcgcaagtcagtggcatcacatccgggcccctggggctttcttgggttgaaagagaaaccagaaatcagattcagcgtggatgggggtgggaagggtgaggtcggtggagggggcgggtttttgggggtgggttgaaagcggaagcggaacgtgattcagtgtggatgggggtgggaggggtgaggttggtacaagggcccgggttgttggggtgggagatggcggtatgagagaggtggggggttgaagaggagaggagtgctggtgggggatggggcgtggatggtttgggagtgcaaatggtaatgggaaaggggacgtggtgggggatgggaataggggtggggtacgcttagccctctcttagggtcctgagattgatgcccggcagagcctggcctcactagtcttacactaaacaccccaagctctgactccagagtcccatgcgacttcagaggcagtggggtggtgggcgccccaagctcagaagtccgcccacaggtggcccacggcaggtaggagtggtgcgggattatttggggtcgtctatctggggtggtggcctcctgagtcctcctcagcgtctcaccttgactcctcacagggcctggcctgcttccttccaccaatcccaagctgctggtcagacagcagctcgcttctctctaacccccaatgcgcaagtcagtggcatcacatccgggcccctgaggctttcttgggttgaaagcggaagcggaaacacgattcagcgtggatgggggtgggggggaggtcggtggagggggcgggtttttgggagtgggttgaaagcggaagcggaacccgattcagcgtggatgggggtgggaggggtgaggttggtggaggggccccggtttttggggtggcagatggcggtatgacagaggtggggggtcgaggaggagtgctggtgggggatgggggcggggatgggtttaggagtgcaaatggtaatgggaaaggggacgtggtgggggatgggaataggggtggggtacgcttagccctctcttagggtcctgagattgatgcccggcagagcctggcctcactagtcttacactaaacaccccaagctctgactccagagtcccctgcgacttcagaggcagtggggtggtgggcgccccaagctcagaagtccgcccacaggtggcccacggctggtaggagtggtgcgggattatttggggtcttctatctggggtggtggcctcctgagtcctcctcagcgtctcaccttgactcctcacagggcctggcctgcttccttccaccaatcccaagctgctggtcagacagcagctcgcttctctctaacccccaatgcgcaagtcagtggcatcacatccgggcccctgaggctttcttgggttgaaagcggaagcggaaacacgattcagcgtggatgggggtgggggggaggtcggtggagggggcgggtttttgggagtgggttgaaagcggaagcggaacccgattcagcgtggatgggggtgggaggggtgaggttggtggaggggccccggtttttggggtggcagatggcggtatgacagaggtggggggtcgaggaggagtgctggtgggggatgggggcgcggatgggtttaggagtgcaaatggtaatgggaaaggggacgtgatgggggatgggaataggggtggggtacgcttagccctctcttacggtcctgagattgatgcctggcagagcctggcctcactagtcttacactaaacaccctaagctctgactccagagtcctctgcgacttcagaggcagtggggtggtgggcgccccagactcagaagtccgcccacaggtggcccacggctggtagcaggagtggtgcgggattatttggggtcgtctatctggggtgggggcctcctgagtcctccctcagcatctcaccttgactcctcacagggcctggcccgcttccctccgccaatcccaagcggctggtcagagcagctcgcttctctctaacccccaatgcgcaagtcagtggcatcacatccgggcacctgggactttcttgggttgaaagcggaagcggaaacccgattcagcgtggaagggggtgggaggggtgaggtcggtggagggggcgggtttttgggggtgggttgaaagcggaagcgcaacccaattcagcatccatgggggtgggaggggtgaggttggtggaggggccccagtttttggggtgggagatggcggtgtgagagaggtgcggggttgaggataggagtgctggtgggggataggggcgcggatgggtttgggagtgcaaatagtaatgggaaaggggaggcggtgggggatagaaataggggtggggtacgcttggccctctcttagggtcctgaggttgatgcctcgtagagcctgccctcactagtcttacactaaccaccccaagctcggactccagagtcccatgcgacttcagacgcagtggggtggagggcgccccagactcagaagtccgcccacgggtggcccacggctggtagcaggagtggtgcgggattatttggggtcgtctatctggggtgggggcctcctgagtcctccctcagcgtctcaccttgactcctcacagggcctggcccgcttccctccgccaatcccaagctgctggtcagacagagcagctcgcttctctctaacccccaatgcgcaagtcagtggcatcacatccgggcccctggggctttcttgggttgaaagaggaagcggaaatcagattcagcgtggatgggggtgggaggggtgaggtcgatggagggggcgggtttttgggggtgggttgaaagcggaagcggaacgtgattcagtgtggatgggggtgggaggggtgaggttggtacaagggcccgggttgttggggtgggagatggcgatatgagagaggtggggggttgaagaggagaggagtgctggtgggggatggggcgtggatggtttgggagtgcaaatggtaatgggaaaggggacgtggtgggggatgggaataggggtggggtacgcttagccctctcttagggtcctgagattgatgcccggcagagcctggcctcactagtcttacactaaacaccccaagctctgactccagagtcccctgcgacttcagaggcagtggggtggtgggcgccccaagctcagaagtccgcccacaggtggcccacggcaggtaggagtggtgcaggattatttggggtcgtctatctggggtggtggcctcctgagtcctcctcagcgtctcaccttgactcctcacagggcctggcctgcttccttccaccaatcccaagctgctggtcagacagcagctcgcttctctctaacccccaatgcgcaagtcagtggcatcacatccgggcccctgaggctttcttgggttgaaagcggaagcggaaacacgattcagcgtggatgggggtgggggggaggtcggtggagggggcgggtttttgggagtgggttgaaagcggaagcggaacccgattcagcgtggatgggggtgggaggggtgaggttggtggaggggccccggtttttggggtggcagatggcggtatgacagaggtggggggtcgaggaggagtgctggtgggggatgggggcgcggatgggtttaggagtgcaaatggtaatgggaaaggggacgtgatgggggatgggaataggggtggggtacgcttagccctctcttacggtcctgagattgatgcctggcagagcctggcctcactagtcttacactaaacaccctaagctctgactccagagtcctctgcgacttcagaggcagtggggtggtgggcgccccagactcagaagtccgcccacaggtggcccacggctggtagcaggagtggtgcgggattatttggggtcgtctatctggggtgggggcctcctgagtcctccctcagcatctcaccttgactcctcacagggcctggcccgcttccctccgccaatcccaagcggctggtcagagcagctcgcttctctctaacccccaatgcgcaagtcagtggcatcacatccgggcacctgggactttcttgggttgaaagcggaagcggaaacccgattcagcgtggaagggggtgggaggggtgaggtcggtggagggggcgggtttttgggggtgggttgaaagcggaagcgcaacccaattcagcatccatgggggtgggaggggtgaggttggtggaggggccccagtttttggggtgggagatggcggtgtgagagaggtgcggggttgaggataggagtgctggtgggggataggggcgcggatgggtttgggagtgcaaatagtaatgggaaaggggaggcggtgggggatagaaataggggtggggtacgcttggccctctcttagggtcctgaggttgatgcctcgtagagcctgccctcactagtcttacactaaccaccccaagctcggactccagagtcccatgcgacttcagacgcagtggggtggagggcgccccagactcagaagtccgcccacgggtggcccacggctggtagcaggagtggtgcgggattatttggggtcgtctatctggggtgggggcctcctgagtcctccctcagcgtctcaccttgactcctcacagggcctggcccgcttccctccgccaatcccaagctgctggtcagacagagcagctcgcttctctctaacccccaatgcgcaagtcagtggcatcacatccgggcccctggggctttcttgggttgaaagaggaagcggaaatcagattcagcgtggatgggggtgggaggggtgaggtcgatggagggggcgggtttttgggggtgggttgaaagcggaagcggaacgtgattcagtgtggatgggggtgggaggggtgaggttggtagaagggcccgggttgttggggtgggagatggcggtatgagagaggtggggggttgaagaggagaggagtgctggtgggggatgggggcgtggatggtttgggagtgcaaatggtaatcggaaaggggacgtggtgggggatgggaataggggtggggtacgcttagccctctcttagggtgctgaggtccatgcctggcagagcctgccctcactagtcttacactaatcaacccaagctctgactccagagtcccctgcaacttcagaggcagtggggtggtgggcgccccagactcagaagtccgcccacgggtggcccacggctggtagcaggagtggtgcgggattatttggggtcatctatctggggtgggggcctcctgagtcctccctcagcgtctcaccttgactcctcacagggcctggcccgcttccctccgccaatcccaagctgctggtcagacagagcagctcgcttctctctaacccccaatgcgcaagtcagtggcatcacatccgggcccctggggctttcttgggttgaaagagggagcgcaacccgattcagcgtggatgggggtgggaggggtgaggtcggtggagggggcgggtttttgggggtgggagatggcggtatgaaggtggtggggtgtttgggaggatggggagctggtggaggatgggagtgtagatgggtttgtgagtgcgaatgggaatgggaaggggttaggggatgggaatggggttgcgggatgggaatagcggtgtggtacgctcagctggcttttagggtcctgaggttgatgcctggcagagcctgcccccaccagtcttgcactgatcaccccaagctctgacttcagaatcccctgaggcttaagtggcagtggggtggtggcccccccaccacagactgagaagtctccaggagtggcccagggctggcagcaggggtggtgttggattttttgtggtcgtctatgtggggtgggggtcctcctgagtcctccctcagcatctcaccttgtctccttatagagcctgggcgggcttccctccgccagtctcaagctgcgagtcagacgcagaagctcgcttgtctctaacccccagtgcgcaagtcagtggcatcacatccgggcagctggggctttccttggttgaaagcgggggcggaaccggggatcctgcctggatgggggtatgggtgttggggggtgggggtgcaggtgtggggtgggggatgagggtgcgggggttgaattggggatgggggtatgagggtggcacggggttggggaggatggggtgctggtaggggatgagggtgtggattgggttaggagtgtggaagggaatgggaatggggtgggggataggaatgggggtggggaaccctcagctctctcttagggtcctgactttgacgcctggcacagcctgcccccaccttgcctcctcacagagcctgcgcctgcttccctccgtggatctcgagttgctggtcagaccaatgcgcaagtcagggatgtcacatccgggccacctgggttgacagcaggggtggaaccggattcggccagggtgggagttggggtgggggaggaggcgagaggtcctggggttaggggttgaggtaggcgtgcccctcagtcctttgattcctggcatagcctggacccctgttctctgcggatggtgtctgctcccctcagaccaaggttctgactcctagtcccctgaggtcacagtggggggagaggtgtccttgggcgacaaagccgctggggtcttccagggctgacaggagggactaagctggattctgtggcccctctttgagcgggggtttaccctcagtcttcactcaggagggtcctcttcctgggtcctggctctttgttgaagtgatgggttggagatgctctttttctctcacctctgagcatttgcccagctgtaccccttgcagaaaatggctgcgggtaccaggcgaggtgttccctgggtggctgcagcacccgttattgtagtgacctctgtgagaagatgcacgccttcccacgggggctcctccccagccagagctggactttggaaaccttttttcctcaaagaaatatattttacatatcttccaaggatatatataggtagcaacatatatatttatttctatgaaagaatacctacccttagtttgcatgattcactctgataccctattcaacttctattccattgtttatgttctgttaaaataattcttttcgagaccagcctggccaacagggtgaaacactgtcttcactaaatatagaaaaaaaattaaaaaattagctgggcgtggtggtgggcgcctataatcccagctacttgggaggctgaggcaggagaatcgcttgaacctggtaggcggaggttgcagtgagccaagatcgagtcattgcactccagcccgggcgacagtctcaataataataataataataatattaataataataataataataatgctaatcctcatccactaagttggtttcaggttgtaattagcagatctccggaaccatactgccttaaccaacccaattttcctgctgtcctgctattaccctagggttactggaatcgtgttttgaggtgctgcctcagattgtgcagtgcagtgaggtggagattttaaaatgttcatcctattcattctgtcatctgacgtctaggcaggctatagacttcaacatccctgcagccaacccccctccaactgacaccgccccaaacataagtaccagttcaacacagtcctcagtctcacccaggactttctgtgttttgttgcttagattttattgcttatattgttgttttttctttctttctttttctcttctataattttccagagttgatttgggaaccagagaacagcagcctaagtgtgactgtaatttttggcagctacaggtaagacactaaattgtaaatcatttaagcagaattgacatttttacaatgttctgctcctgatcaatgaataggttatgctcctttacttatttcaaactccttttacctgaatctgtcagtatactttgatagtttcctctagaaagaccttacacatttttcttaggcttcttttttggtaattcttggattttgttgctattgcaaatggcatattttctattaattgttctaattaatggaaattaattaactctaatagttattgctattgtgtggcagagaatttgattttgctatagtaatctgttgtacacctcattctgaaaacccattgacttgaatattccacatgcctttttctttgaattttcaagaatgataagggtattatcactaaacattatgtatttttcctatattcatgccccttatttattatgatacttatagctctgactttgtgtctcaatgatgatttaaaacgtagagataatagcctacatctacttcgtgttcctgcctttaatgataattctttgaacttcttaaatttgtttgctgttgattttaggaaatgtatgttctctttcaatataggttaactaaatatttttaccatgaactcatattgaatttcttccaaaagcttttcctgtacccattgatgtgataaattttttctcctctattttgtgtgtaaaaaattacaatgaaacttttttttctaatgttaaatcatattttctttccttgggtagagcttgtttgttcatttaatattctactaatttacataagatatttgctgctatgtaagagagcttgtttatgtgttttttccatcgggagtggggggtggtcctcatctgatttttgaatccagaagggttaatctgggagaatgaattgaagaattgtctatattttgcgtgctttgaagagttgagataagatgatggttagttttccttgatcatttggtggaatcagcctccgaaaccgactaacctgggacgtttgaggatggcttgagctttgaatattgtatagtttcagtttgtgtcgtttaattgaagttttctttttggatcaatttggtcatttgtttattttatttctacaaaatagttggatcatttaggatttcatttttaatggcatgatatttatgacaaaaaacgtttttttatcagggaagcctcacacatatagaataatagagagactaacataatgaacccagcatacctgacgctcagcatcaacaaccttaaatacacggcaaatctggttccagttagacactcacctacctgcatctcagctgctggaataatgtggatcaaatcaaagacagcataccatttcatctctaaataattcaatattcatttttaaaagacaaggacattgtacccagctgtacccctcgcagagaatggctgcaggtaccaggcgaggtgttccctgggtggctgcagcacccgtgattgtagtcacctctgggtcacaatcactacaaataaaaacccaatacaattctcatttctaaaaaataaataaatgattatgaaatgttcaactgttttatgcacttatctagaagacttatactttataaaaatttgtttatttggatgagtacccaaaaatagtattacatagtgattttttgtaattaaatcttctctcacctgtaggtcccctccacatgatctgttttcttgccatcgcttcgttgttggaaagaaacatatcttatgttctttccagttttccatagtctggatttgcaacactgtaatgtcctttatcatattctctagcccttaatttctagggctgcaaaatggcccaggctcgtcaggtttatgccctgccccagtcataaataagccatttctccaaatatctggttccttttaatgggaaatggttctagaaatctacttctgggtgctaggtgtgctcattgctacttttgcttttggtgtttaatttaaaagctctttaacaaacaaagttatgtaaattttctcatgttttcttatagaagttgtatagtttttgcattttgcattaggtctatgatgtattttgagttaatttcgtgaaatacctaaggatttgtctaggttattattattatttttgtttagatacccagttgttcatgtaccaattgttggaacaactatactttcacctttattgcttttgttataaatcacttgattgtatgtgtgcaggtctatgttggggctctattctgtttttttaatctacgtgttttttaatccattcaccaaatgaaatacatcttggatgcctctgtttttggtgattatgaaataagctattgtatacattaatatacaatttcttatgtagatgtaagtttccaaattagttggatcaatacctaggagtaggattgctgaatcttatcgtaagactatgttcagttttttaagaaaatgccaaactgtcttccaaagtgcctgtaccattttgcattttcaccatcaatgaatgagagtttctgttgctccatatcttcatggactttttttattattattgtagacattctaattaggtgtacagtggtacctcattttagtacacacttctctaatgacaaaggacgttcagcacttttattatgcttatttgccatctgtatatcttctttggtgtagtgtctgtccagatctttgactattttcatttatttctatcatcgagttttaagaatttgtgtatattgtagagacaagttgtttatcacttatgtatactacagatgttttctcctagtctgtagcttctgtttttattctattcacactgtcttttgaagagcatactatttttattttaataaagtccaacttggcaaatttttctttcattgatgatgcttttggtgttgaatttaaaaactcaccaccaaactgaaaattatgtagatttactcttatgttttcgtatagaagttgtatggattttgcattttgcattaggtctatgatgtgttttgagttaattttttttgaaatatgtaaggatatgtctaggttattattatgtgtgtatagatgtccaatgttcaggcagcatttgttggaaaaactatacttttaccattattgcctttgttgtaaatcacctgactttatgtgtgcaggtctatttctgagccctatcctgttttattaatctatgtgtctattctttgctaatgcttatgtcctctgccaaattcatattttgaagctttcggccccagtatttctgtatttggaggtggggcctttaaggaagtaatgaatgttaaaagaggtcataagggtggggccttgatcccataggattagtgtgcttatgagaagggacacaagaaagcactcttgtgcttaaatgagaactctctctctctctcacccttcctcccttccttctctccatgcacatacacagaagaaatgccaagaatggacataatgagaaagggccatctacaagccaggaataagaaattacagcctccagtcctttatctgtgactttcagtctccaaaactctgaaaaaaaataaatttctgttgtttcagctacacaatccatggcattttgttatggaagtcaaagctaactaagacataaccccaggtaacaagtttttcttctgttttcttctagaaaaaaaagtatttttgacatttagggctatgattcattttgagttacacttttatatggggcaaggcatgtgcaatggttagttttatgggtcaacttgtctagactatagtactcagttgtgcggtcaaacactagtctagatgtttctgtgaaggtattttgtagatgtgatcagcatttaaaatcagttgattttaaataaagcagtttacctccataatgtgggtgtgcctcatacaatcagttgaaggtcttaaaagaccaaggttttctggagaaggaattctaccacaagattggaacataaaaacgctgtgtcagtttctagcctgctggcctgtcctatagattttggatgtatcagacctcataatcacctgagacaattccttaaaatacctttatttttctctctccctttttagatagatagatagatagatagatagatagataaagtatggattgaaatttagttttgcatatggatatccaattgttccagacccaattgttgaatacactatcatttctcccctctaatcttcatttgcatctttatcaataaatagttatctatagatgcatatacatgttgattcattcctggagtttattctcttctgttgatatattgctgtaattatgacagtcccacactatactgatcattgttagtttataagccttgaaatgaagtaaggtaacgcctccaactttgttctattttttaaagttttctttggctattctaaggcccttgcacttctatatgaatgttagagtcagcctcccaatttctatttaaacatttctggaatttgatttggattgcactgaatcttccaaaaaccttgagggaaaatgacatcttaatattcagtcttttgactaatgaataaagtttatatctctatttacttagtttctcattaaatttatctctgtaatgttttatagttttcagtggacagatcttatacatcttctgtcatatttatccatttaatgtttattttaaattgcattgttttgtctcaattgccaattgctcattgctagtataaaaatacaggtataatgatctatatccagtgccattgctaaactcttattagttctagaagcatttttaagattgatagaattatctgcatatgctcttattttctgtaaataaagacagttctacttgtctttttccaatctgaaggccttttttgaaaaaaaaaaaaaaaaacttattacactggacagaaccacaggcacagtgttgatctattctactcaacaccaccctgttccatgaactcatcagtcttaggttgtatttttctacaatgcaaacatcctgcatgatttctgacatgtgaaaatctgcctcattcaccctacactgttaaaatccaaacatgggtactgcacctgctgagatgagcatgaccccacagttgaaacaagattcataagatatccagtggaggaagtgtattcactgaagtttgacagcctgaaagcagtgatttcagactggggaaaactgaaaccccaggagacttctgtggacactgggaaaaggaagtaagattgaaaagttccctggtagcagccaagtgagtggtcttcaagatgtataagagaaatttttaggagggaagtagggtgattcacatttacacatagacttaaatacagccagattatcttggagagatttctggtaaaatacaataataataataatttttaaaaaactagataatggtgaatggcaggagaaaacagaaagaagcattgaaatggagtgacctgggggaaaagcttggaggaaatactctctccctgccatgtgacccaccccagttgaacatgggaggaaaggagcagcactatctgtttgggaaagctctttagcagttctaaagaaatgcccctcttttcttcaaccagaccactctggcttcctcctcatcctcccgtcccctcctcgtctttcctcctctcctcctctctctcctcgcccctccctctcatgacaatgtcctgagggcggtttgtgacatctaagaccttctccacgacagggcaaccattggctaggtagtagcttgctgaccaatcaaagctcaggggtctcgttcgtcattgtcctgggaggggtatgtatagggagaccaggcagcctggaatagacaattgagagacgctggcgaagatgaccaggaaacgacgagcctccagcccacttttggaacaatcaccagccatcaccaaaatggcgaggaagatgaaagccccctctcaacctagatccagaagccctatcaagataaatgaaccacctagcctcctccctttcttgaccctgactcttccctcccaagactcctaccctgtcctcacctagcacaaccctcacctcagcccatgcctttctcatgaagcccctgttcccgccccttctccatcctctttccccaaaccaatgcccttctgagatctccctgttgtcattccagattcccaagacaactaggaagggaaaaggaacccttcaaggaagttccaggaaaaacgtctctcccaaaaagaccaccgcttcaggaaaacctgaggaagggagtgggccaacagtatcctgccactgtgaccagctgaacgaggaactccatcaaaatgagccacagctggaccaaaacagtgaggagacctccaccttcttcagtgtctccctgagcagtcagtaatttcagggcaagctgagaggtctccagaggtctaaccccagataaatagccaacagggtctagagtacattttatacccaacagggtataccccatggtgatcaaaataaaataaacctgttgtaaaatgatgtgtgggtctgtgtgctctctgatggtggggagggaggaaggagggaagaggtgggagtttgggaagggatgggggtggggtccttctttaaattcaactcgttcttctttctttggtttcctagtgtggatgttttggttattgattttagatactattttctaatataaacatttaaaatatgctataaatttccctcaaggaaatactttagctgaatcccacaaatttctgtacatataattttattttcattcgacttgatgtatttttaaaattctcctaagactccctctttggttcatagggcatttaggagcatattttaaaatttccaatatttgggcatttttcagacatcatggtgtttgattttgagcttaattacattatggtctaagaagatgctttatattacttctattcttttcaatttgtagggtttgtttgatggcctagaataccatataccttggtaaatacttcatgcacactgaagaggaatgcttattctgctattgttggatgcgttttttttttttattttaattaggtcagagtagttaatggtgctgttcaggtcatgtatttcctccctgatataagttttctgcttactttttctctaaaatactgagaaacaatgcagagttttgaaaaatatatagtcccaagaaaccacaaccacagtgaaggtgcaaaatatattcatcatccccaaaagtttattcctattattttgctgtcaaaccatcccttcagtaaaagtgacccgcattgagctgaagtgagcatctgccaaccatgaacactttcccttacaacagaggcaggtaggcacagagaggggcagttattctcacacacaggcagtatccaggaagaaaaccagatcggtagtgtcatagaaggccagcttgctggcctggtcacaggacgtccctccctttcttgtgcactgcctgcctccaagtctggctctgccttcctggcctccctggctcagatgagtgactcatccctctgcagttatgatccaggaatttcaaccttgtccaactcccagctgcttccttagcatgacccaagtactgcttcctgactaaggcagaatatctagtctgctttatacaccagacatgtggactttggtcctaaaggtttcctgaggaaggcacatcaagcgcaaaggcagtaaccttttatttcctcacccaagtgccacatgggaaccacaagtgacaggctgtttgacatcttgtagtcacactctgagcactggggtgttgcagacaaaagtcttggtaagcctggtgaggaagatatttttccactagtttctctggcactctcttttccagcagcccctaagcccactgccaaatgcaagagtctcatgctctgccacattgcagctcagccacagtgatcctctcggcaccatggggattaggaacacaatgtggtgaggcacttatagatgacagtctaacagcttgctctattcccatatttctgctaaaaactgagtccccaaggggggactaagacattgaagctaacacgttacggtttcccaagctctttaatatatagtattggaagaaaggcaaaaggaggctcctatttccattcttggaagtcagaatcctggagttctacttggtaaagtgtcttgcccagggtaaggggcttttgatgtttccactgccctgtgaaaccttttccacaactggcataggggctcagttgggccagccagagctctgctcctgagcagctgtgagtatcccgtgttctttacaaagaacactgtacagagcaaggaatatctgttactgccaagtagaatagctggcagaaccagcaagaaccttagaggtcctcattctatggaggaaactgaagaccagagacaacaggatcttgtcgaagatcacaagcaaattcatcaatggcagagctgagctgctattgcctggcaggcttgggatcatccagggaaaatgtggctgttccctgtggtttcacctgcctatgtgtgcctctaagagtgtgccactattctttcattgcccctccctctgtctgcataggctatgtggattgtcctgccagcctctctccacccctgcagggtcagtgccactggttactacagttcagtggccaggcagaggaccttgtggtctcatagacccccagatgactggagggggaataccctgagaagtcccaggatcagcctttgtcttcctgatggagagccccactcatcacttctcctgcctctggcctctcactgacttggcttgaatccgtcactcctgctccagcccaggccatgttttccctgccttctatgcctctggggatttattcatagcacttccatcctcctctctcagactcatctttccttaccaccaaaagccacaaggtgggaggctgggccctcttctcagtgtttctgtggacttcatgagtcttcccaaaagttttgagaggtccaggttaccatgctcaggaatagaggctagaaaagtgaagtaacttgctgcaagtcacacagacactaaggagtaaagccaggattggaaccataacttggatttcaaagcctgggctcctgccactgcacatgagcctccctctctaggtggcctggagtctcctgctaggagtgaagaagcaattgtggcatcatggtgatggggcaaaatgagaatcagaatacctcgatcgattccagttccagcttggccccttgctgcctatgcagccttgccatagccacctcatctttctgggccttggtttcccagctatatagtgtggactaccctgcaaatcctttctaaacttcggtcagtcaacatatgtttagcgcacaccgattttgtgctagattgttccaggcactaggggacagttacataaagtctcaaggagctcatagtctattgagggcggagggttagaatacataaataaatgaccaaagtagattattcgttgtttgctgagtgctacaaaggagattcactaggaaaagcggtgggaagtgctgggggtggggggctgctttagcgaggatgctaggagcttagggttcgcatgtggctctagcagaaaagcacatgtggaaatgctcagcacaccaggccataatgcaagaagggcaggccagttggcctcttaccttcagatcctcatatcccattctcagtcctagccatctgctcctacttcctggtcttcaacttgccctggcttgaatcccttgctccagctccaactcgggccctatttctccgtcatccatgcctccggggctttctttgtaacacttccatcctcctctctcagactcatctttctttagcattgtctgaggtgcacctactgggagaaacctgcccctctccagctccttctgaggcctcacatatatgtcttcttatgctctggcctacaggatgtgattctgtgtaagaatagctcttagcatgcggatacttcacttagcccaccagacaggatctcagaaggctatgactgcttcagaaccattttggtggctcctaacgttacccagcatgctgcttggcacagaggaggagtggtgctcagtttttgttgtttgacactgtccatagtggcagcaaggcttacaagctcttaaactgaaggctttgtaaagcctggcactgccagggtagagacaagcagaggctggtggtagggagaaagggaatataggagaagagagcactgggtttgtccaaaatcactgagatagaagacctagaaccttccttcatgaaatactcttttctctatgttctcacagatcactttcttctgactctcttctcattaccggctgatccccctcagttttctctgtccaaccattaagtgtgggtgctcctcaggactgtgccccaaaccctcccagcttctcctctctgtcatcatacactccctggctaatattattcattctctctctccagcctcgtctctctcctgagcttctgagctaagtatatggttgtttcccaggtccctctacctggaggcctaacaggcatctcagcctcaataagacccaaaccagcctcatctcctacactcccacacaagagtaccatgattaatccagcagtcatcagaattggaaataagtgctcaccacgccacctatttcacttctaaataacttctaactccatcttctcatctccatctccactgccaccatcttgatataggcccttatgctggtccatttgccctcagagctattcatcacccttcctctgctcaactctgtttttcaggctgcattttctaatctcttgtgcctcttggagggagattggagggtgagaggaagggggaaaccaggagggtatatattttgttcctctctctgccttaaactgcatccgtctcccctgtgattccatttcccaccaacagacactccatgattccagtttccaccaggtgaccctgtcccaggattctggaaaccctggttccattctttgtctctccagccaagggctggtagtgatttcctgctgttacttatctctgggttgactcatcgtatgcaatttggctcatcagtaattccatctcctatgtaactagttccctgcattacatttatcctctaaaaaaaaattggaatggcttctctttccctggttgaaccctgactgatatagcccttattacttctagcctagcttattgtaacagctttttagtaaatcatcctgattctagtcctatttctctctaatgttctcttaaccctgcagacggagaaatatgccttacgataacttttcataaaacttttcaagagctccccattgcctagaagatgtagtccttaccttggcttgcagtctaatggtgggatggatgggagaggagaccgttgccagtgtttggttaccagataggggccagggcagcaagtgagggatttcccttagctacagactcagtttcagattccgtcctcacagaagggaaggtgagctcccaaaaatagccttggtgagtaataaagatttcaagaccccctgactgatccagaccaaccaattggaagctcctgcttcatccacttgctacatttacaggacattcctgtcacaacagaggaccaaagtatacctggcaaataagctcaggagagtattttctttacatagttctcctggcttaaaaattgaatttgtaaaaatttttaaagaactttgatacaattggattttttaaagatcagggtgtcagggctcaaggaaaataaaaattagaagaaaaaagatggagccagggataagtttgtgcaaaccacgcatgctgtgggattctgtacttttggcttagcctggaattttttagcagccggttctaggagaaaaactctcctttacatgatcctcagggttcgaaagacaaaaaccaaccgctggctcatagaagcaaaactatttcacgtaatacatgagaaagaaattgcttctagggatcttcataaagaggacaagatggacttagtgaacaacatcctcaacaacattttcgaagttctaagggaggcttctgtcagaattagagaacatttccctgggttcatggtttaagtgtatatgctgttggggagaagaggatctggagttacattttatctgctttgtattatttttgccattgtttcctcagactcctgtactgtaatacttactgaacttgtgatgacctagaattcttctacctttgcctctcccttgattaatataccaggtctatgtcatgtggacatttactaatccatccagcaaccacttatggataacctactgaacttccagtactacagtggtgaagaggattgatacagcttctgccactaggaaattgaaaatgtagtgtggggagacagatgataaataagccaacagataaataaagtaaacaaaaatattgataatgatgatggcttgcaggaaataaaacacagtaatgggataatgtttggggtagggggatgctaatttgtataagatggttaggaaaggactttctccagggttaaaagttgagctcatacttgaataatgtgaaggaagaaaccatacaaagttcttggatgaaagtaattcaagaaaatgagacaatcagtgtaaaggccttgaggttgaaagcagcttattcaaagaacaggaaatagatcagtataactggaaggagtaaagcaaggaaaatggtaagagatgcaaacagggaggtagtcaggggccagattatgcaggacctttgtaagtcaatcaattaataacttggaatgaattagtagtgaggccagagatgaaagggtgacctagagacactgtatgtgcaaaggtatacagtaaagttttgtaccttcagtgcttttctaaaaaacgtcagaaaatgttgagaattcacaagaagatagaggggacaccccaggaatcacatatgcaatgtaaaggtaaagttcactctggcagcagttgatttttctcttctctcctagaaatgtaatgcgagttattacagtgttggcatgaggttaaacctggaaagggctataaaatgttatgacagggaaaggaagttttctctttcttatatgggttatttacagaatttctcttttggagatagattggagacattgcccaagctcccatgacattcatccagagaaagcgaaatcaataacatggccaacaaatctgtgagtcagagttgcattttctacttttaagttacctacagactccaaagtgccactgatactaaaatgagtatgttacaatcaataacccataccttggtaggccacttcttgtggtgtagttgcaatagttaagagaaaaaataatgagaacctagactaatataatggcaatggggatgaaaagctagggatcgacttgagaaatgtaaatcaaacaaaaatcagcaggatatggagattagttggataactcccaaagtcactacatcggtgactgtgaggatgatgcaatcattcactgaaataggaaacacagggaagcagttaagttgcatggggtagggtaaggatgaggtggtgagttcagtttggctctgctgcctttgaaatgcctgtgggatgtgcagttagagatgttgtgtggatagtttgttatatgcattacgaagtcaggagagctatgagctccaagtaaaagtttttgtggggagaagtgtcttgagcttagaggtggtggttggaaccttgatagtggagaagactgtccagggaaaaagttatagccttaagaaaggaaccctgggttgtgtaatatttgacagatagttaaagaagtggcaaccccaaagagaatgaggagagaaatcgtaagtcaaagaagtagagtgtttccagaaaggcatggccaacagtcttcagtgttactaaggggtcaagtaaaaacaggactgagacttaatgatggatttagcaatctggatgtcattgctgaccttgacgtgagtggttttctgtggagtagtgagtagaggccagagcagtagagtagattaataagcaagtgggaggttggtaaggggtggaaacaataagcatacatgtctctttccaagagtttgacagtggtggagggagtgggggaaagatatggtggttggaagataacatgattgtatatgcatatccaaactcaccaaattgtatgcattaattacgtgccgtagtgcagtttttctgtacactaattatacatcaataaagctggatttaaaaagaaaaactataggccataggtttatgagttttaaaaaataattatgagaatctttttttcttttatactgcagcaatttgaatgtgttttcaagtttggagaagaccttagagaaaaggagcatgaaggagcaggagagaaaaggaaaaagcgatgaggagacagaaggggacatattaaggacttaggggtatgagtgtgggagaaatgcttacctttaacagaaggagagacccctctgagcctggaggtgaagtggtcagagaagactcatacatcgatagcagggcagagtcagggagttaagagatttaatttctgatggcctccatgttttcaaggaagtaagagcaaagttgttttctataggcaagaaacatgacaatatttaggaggcttgaggaaagcagaaagtgtttattttagtgactggtgaatgtaaacattcgagaagtcttgctggccagtttctttgcagtcgtacaagactttttgagcttgccactcatttacaacttaactgtccagccttatctgctggatgaaaactggaggagaaggtcactatggccatggaaaaatattcccttgcagcagtgattgctcagttgaggacaaaccctgatttataatgaggctaatcatggttgtgtgatttgcccccgctagcctcagagctgggtctaaaagaaaagaaataggattatggattattagttcatccagggatatgattttgttgagtggatgcaggagaaagagataaatgcacaaggatcaagagttctggggacaaagttgttccactgatccatcatgtattgggggactggcttgggatgaaaggaacagaggcttgaaggaacctgctgcactgggattaaagggatgcaccccgtggccgaagaactgtctgaggtcaaagagaagtgacttcagtgggattgagttcaaaggataggggcacatgatcaggggatgtgatctgaggtctggtgggggtaacttagctggggtttcagcatctgagcttttggataattctccgcatctgtctgctcattgacattggctgacagcttcctggaggcctgcctcaggaaaagttggcagcagagagtggatgagtgaacttggaaaattccaattctttttgagatggagaaggggtgctaatactttggacccaggagaactaaatggaaataatattttcaaatggaaaaggcaccacaaatgactaattagaaagaagacttttttgtctcctggaccaactgagaaatgcatgtgatttggagcatagtgactttttcaatctcttggaaatggctgtggcttttcctatgtataatggcattaattaagctaaaattgcttccattctctaaaaatatatgaatacaataagaaaagacattggccaaattaacagaaacctgaggatttagtggaaatgatttgtgttctttatgaacttggatcagagttggattaaacaagtcagatgcaaagttctaggacagactggcttgatgatgtaacaagctggctttggtcactggctggccgacttcagccaaggagccagctctgagggcacttggctttatattggctgtgaaaccccacagccatggcacccgctgcttggtcctgatgggacagacatgatcgggagaccaggcggaatctgtcagccagctgctctcctaggctgctctgaacagtctgagtatcccattcttcgtgagcatttgaacctgttctgacctttaggctcgttcctgtaatagacagaagatcatgaacgctctgttttcttttagttattactctccttctatcaaatctcacagtgcttctcacattttaatcatcataagaaacacctggggatcttattcaatgcagattttgactcagtaggtctgggttgggatctgagatgttgcaaagtatcctgatgctgatggtctgggggctacactttgagaagcaaggctctcaaccaggactttccccaagagagcattccctactcaccttgttagtgggcatttactgaaaatcccccatgcaccaatcactgtgcaaagcactggggtctggggtcggggggataagaagaagataaagagaatacataaggaacaagacacagttcctgcccaaaacagaataggtgatgatactgtactcatgcctgtaatcccagcactttgggaagccgaggcaggtggatcacctgaggtcaggagttcgagaccagccgggccaacgtggtgaaacctcgtctctactaaaaatacaaaaattagccgggcatggtggtgcatgcctgtaattccagctactcaggaggctgaggcaggaaaatagcttgaaccctggaagcggaggttgtggtgagctggtatcacgccactgcactgcagcctgggtgacagagtgagactccacctcaaaaagaaaaagagaaaaagaaagatagacaggggattgggggaacacagagaagaaaataatctgctaagatttttcagaagaattcacagaggaagtgacattgagatgggtcttgaaacctgagttggagggcaccaggcaaagagatgcagagacttttccagcaaagggagaagcttgtagaaaggcctagaaatgtgcagcatgtttgagcaatggcaataagtccaatgtcaccagagtcccaggtggccggtggtgaagagtggcagtagatgaggctcaccagctaagttttaagtgagagaaaaggtcacagaggccttggttaccctgctaagaagttgctcagcaaacttatttgcctgtttacacttatcagctaaacaaaaggtcaggcaggtagactgggcaggcagatatctcagaataacagtaacttcctatggaacatccacaaatgctcctgcctcctagactgggctaggcctcccctgggaggaaagcgttggcagagcctgcaaaggggcaaagccttttgatagccatcattggaaccaaattaatgtgctaattgctaacaggacgtatttgtgcatcagagtcagcatcaaggctctaggctactactttgtgtctgatttgctgtgagaatccatgtgctttatgtaatgaaaataattgtctacttttctttaaagactgtatataattgggcctttaacaaatttatacaggctctgtttcccactgactgccatcacagcacagccaagttccatcggtacaatgaggggactgaaacctgttagccttctctagtttagcagggtaaggacagcaaggggaaagataaagagagagagacagagacagatacatagagacagagatagggaggcacagatatagagggagaaatggaggaaagaaggaagggaaggaagaagaaagggaataaaaagaaaaatgacatttaaaaattaaatttagaaaaagacatttaaaagacaaagcacataggtagctatcaccatgggcaaaaccagaactgtgtcgaacattattacgctcaatttatggtttacacagtagcaaaaccattaattttaattgcatatgagagagtggcataacctttttctagtttaggcccttttaagcttataatcaggccctgttctggggaatttaaccatctggagcatgagtatatgaggtatgggtgtgaggctgagctggcctgaatggtccagccatcagcactgaatatttggtcactcccattcagtttcaccccaacaataaaattacccaccaggatgaaagtttccatccttacttacaaactaactttattggatttagttgcgtttggtcatatacccttttttccactagctgcatgaggctaaataacttacttgattaagttctccatgattatccaatttctctgggcataatgcagccatcttacatgaccagaagtgagcaggcaagtgatgagctgcttattctaacttctcattctaaatgactgtgaggatgctggctaacaccctctggattcattactgggtctgggtaatttgtccatagtgtcctgtggaatttggctactaacctctgtgcctcatgaggaatggcagagctggccggagaaagggaaaagaagggagcttggtggagcctgactgaaaacctttctgtcagacatgaaggactggggaagcagaccttctgcctgccattagctttacacctaggttccaattatgggcaagttgtttcacttctttaggctttacatcagtgaagtggaggtgtagtactaacaactacctcttagatggaactatgaatgggtggggatggggggcatccattcattcacgtcttcattcatttaacaaatatgtattgagtacctactctgggtcaggtcctgtggaggaatgtggactacagtagtgaaaagaatagatatcatgctggactttctgttagaggagacaatgaacaaatatataatgtcatcacagaaggtctccctagggaggtggcatctcaattgaaacctaagtgatgagaaagagccaggcctgcaaaaatcaggaggaacagatttgaagcagaaaaaaaaaaccagcatgatcaatcactagggaaaatcttggcttcttagagcagaaaaaaggcctgaagccttcagcagagtgacctaggagaattttggtgataggagaaaccatagaggtaataagggcctggcaagaccatgaaaaggtatgtggattttatttgtggtgtggtgggaaatcactggaagcttttaagcatgagagaaagataagtgggtttagctatttaaaagatccctctggctgctgtggcgatagtggattggaagggctgagagtacacatggggtgactgtcacaatgctctaaacacaagatgttattagttcactggagttgaatgaaccccttaggttatggctttttactaagcaattaattttgttttgataatcttccattctcctgcctcattctccaattttccctcaccgcattcattaaccacttctgcctgtgagccacagcttctctgccttggtgggtctgggcaataaaacatgatagaatggaggagtaagagtgactgaaggaagaaatggatggactgatggatagctaggtggatggttaggatggcccatatcatctttatatatccctaatgcccaggagatatcctgacacaaagcaggttttcaaacattgactgaatggatgaaggattgtgctgagaagtcaaagtcagtttatctccagaatgagaaatattgggtcctgttgttttagtggtgaaagagttataaactttaggttagagaaaattgcagaacaaggacttgggaagaatatgtaggcaaggtgggcctcacttgaagaaaataggtttgctttttttttttttttttttttttaaatggagtcttgctctgtcgcccaggctggagtgcagtggtgccatctctgttcactgcaagctccacctcctggattcacaccattctcctgcctcagccttccaagtagctgggactacaggcgcctgccaccacgcctggctaattttttgtattttttagtagagacagggtttcaccgtgtttgccaggatggtctcgatctcctgacctcatgatccacccgcctcggcctcccaaagtgctgggattataggtgtgagccaccatgcctggctggtttgctgtttttagtaataattgactcagaagaaatgtttcaaagtgattttagaaagtcattttgcatggacattgaccacatgtttcttgttgatgataatacaaacatgaaagacttgggttagttgtaagttcattcccgatataacaaacaacccttcaaaccccttaccaagttttggccatctcagtaagctgcattaccttccacccagttccttaggccagaaagatagcagttattctagactttccaccctcttttgcttactacgtctaatatatcaccaagtcctatcaattgtaccccttaaacatctctctgatccacccacttcttaccatgccaactgacaccatccctttccaggccactgttaattgctgcctagacttctgcaaatgacttctaattggtctcccagcttccactcttctacctaatgcaatccattctccatctagcaaagacatctttttaaagaacaaattagatcatttccttcccatacataaagccctccaatggctagctccaatgcctacctttccagcttcatttcacacctgtctctttgcttctactgtattctcctgccacactattcttttagaatatttttctgaaatctgtgtcttcacatacttggttcactctgtctaatgtccttctgtgtctccctacttcctctactgctcaggaagggacactagttttggaagagacaggtccaaagcatgagataggcagaatttctcaatctctacccccactgcagtcagtcaagcatccaacagcagaaattcttgacctgaagctgggtgaggagagaaggggaagaaaaagatggtctgacaatgaatgatgacgtcctggtccatctgggagcgtctgatctcttctcatctggtcttacatttatttatccagtgccagtgctggagattagcctgagccaaaatagtaacttcttgtgccaatgcaagttgtagctctaagtaaggggacaacattatccaggctgatttatttctgaccaaccatttgagtcagagcactggagaatgtagaccttggttgaaggccttcaggaaaatacaaacctattccatattctttatggtttcaaagtccatgcaagggccggagccactcctgataacacagtttctgagcaatacacactccccaggtctccctggtaatccagttgccttggaaacacaatgatgcgagaatgatacctacagtgaatggttgctgcttatctctattaaatgaaaatcttcactcatcagagttttgaaaattcagacaggttcctttttatcttgatcccactgcctggcacattctattttatgccaaaagccagcagcagcccttcacttctccctaactgatgtagacactttttctggttttggattttgctactgtcgaattagctattaccctttgaccccaggacaaaaaaattacaggtagagagtgcatgaacttttccttgttgatcccatctgaaagtagactgagttgagagtctgaggtatctacagaaatctctgcccatctcacaaatcttgctcacagattatattagcctgttctcatgctgctaataaagacaaactgaagactgggtaatttataaaggaaataggtttaatggactcacagttccatgtggctggggaggcctcacaatcatggtgaaaggcaaatgaggaacaaagtcacatcttaaatggtggcaggtaagagagagcttgtttagaggaactcctgtttataaaaccatcagatttcatgggacttacttattcactatcacgagaaaagcatgggaaggaccaatccctcattattcaattacttcccaccaggtccctcccatgacacatggtaattatgggagctacaattcaagatgagatttcagtggggacacagccaaaccataccattccactcacagcccctcccaaatctcatattcttacatttcaaaatcaattatgcctttgcaacagtcctccaaagtcttaactcatttcagcattaactcaaaagtccacagtccgaagtctcatctgagataaggcaagtcccttccacctataagcctataaaatcaaaagcaacttagttacttcctaagcacaatggaggtacagtcattgggtaaatatacctgttccaaatgggagaaattggtgaaaacaatggggctacaggacccacacaagtccaaaatccaatggggcagtcaaatcttaaagctccaaaatgatctttgactccatgtctcacatctaggtcatgctgatgcaaaaggtgggctcccatggaatccagcagctctgtccctgtggctttgcaaggtgcaacctccctcctggctgctttcatgggctggtgttgagtggctgcagcttttccaggtacacagtgcaagctgtctgtagatctaccattctagggtctggaggacggtggccctcttctcacagctccactaggcagtgctccagtggggactctttttgggggatccaaccccacattttccttctgcagtgccctagcagaggttctccatgtgggctccattcctgtaggaaacttctgcctggacaccgaggtgtttccatacatcctctgaaatctaggcagagtttcccaaacctcaattcttgacttctgtgcacccacaggctcaacaccacatggaagctgccaaggcttggagcttcttgtaccctccaaagccacggcccaagctgtaccttggcctcttttagctaccgctggagtggctgggatgcagagcaccaggtccctaggccacatacaggagggggctcccaggcctggcccaggaaaccattttttcctcctaggcctatagtcctctgatgagagcagctgcaggaaaggtctctgacatgccctggagacattttctttattgtcttggcaattaacatttggctccttgttatttatggaaatttctgcaaaaagttttgtatttctccccagaaaatggatttttcttttctattgattgccaggttgtgaattttccaaagttctatgctctgcttcctcttgaatgctttactgcttagaaatttattttaccagataccctaaatcatctctctcaagttcaaagttccacaaatctctagggcaggggcaaaatgtcaccagtttctttgctaaaacatagcaagagtcacatttgctccagttcccaacaagtacctcatctccatgtgagaccacctcaactgagactttattgtccatatcactatcagcattttggtcaaagccactcaacaaatctctaggaagttccaaacttctccacatcttcctgttattgattggtgggattgtaagcaaattaaaaagttccactttttggtcacctgatatacctattctacacttggcttgcacattcatgctgtttattctaacaatttttcatcatagtcctaacctcaagtgtctggttaagatgaatgttttctggagctagatctccaggagtccttactgtctcttagtagggtgacttgaactaacctttctgagcctcagtttttgttcatctctaaaatgggaatcatagtagcacccttcctcatgggtttgtaaggatcaaatcagataatatctgtaaagaacttagaatacagcctgactcttaatgtacaataaatgtcacctactgctgttgttttcattattaaaacagatgttgaaaaggaaactaacctgatctgcagctacacctgccctagcatgtttgagtattatgcctctgagctctctgtttctcttcttggctgtctgttctttgcttgccttgaaccttgccagatgttactgctttgacttgggcaagaattcttaaaccacggatggtaaaagctgaggaggcttctcagtgcataacagggaaaagggttggcctgagctcaatcacacagcaagttggtggcagaacagggcctagactaatgctttttgggccaaattgcagtaatttgttcactctataaacttcttctctgtaccctacctcctgcaggtacccttccacccttccccttgggtctcctctccacccaaaacaggtaggtcctgagttattagtaacactcatttttagaaggttgtgaagtctcatgtcctatgaagagaaaatagggggaagaagtgagaaaaacaacagcaaaaaaagaacaatcctggaaaatcaatataggccacattcttctgaggtccatacatcagtaggccagtatgaaagtggcttgtctatgtaaatgggttgctgttattttctactaaagtttaagttgtctggcttcagttcacagggctttaagaatgcccagcttagtttccagttactccaaattaggaaaaatggggaaaaaagaaagaaaaaattgaaaacattattttgaagactcatagccaagaaaaattagagtttgatccaaactgtaggaaataataaaaatcaaaaaacatcagacaagactagaatctaacaacaggtgtactatagtttttgaaacataatttttctttctccagtttcccgtttttactaaagacaaatcatggtaggactggtttgctttattatacttggcctaattatttgtacacagtgcagcaggaatagttattttttacataggcttttaaattggctttgattgaactttgttccacagaaggaatctcagataagacctttttaaatccatacccagccatgaatttataccatgaaatacccatgagtttaatgaattcctctcctcttgaggttccaagataaacttggggcttctgggcctgtcagaaagtgatcttctttacttaccatacgtcagaaaacctgtacaaggactgtgtagacaaaggtatgaggccagtttttccaaggggattttattggctccataaatcaagttagatttcttaaaggaaagcaccccatttcagtcaaagcattggtaaaataaccagtttctccaattgtgccctgttacaaatgaaaacagattcttattgcacttttgcaaataactatattgtcataagttataaatcctcacaaatagtttccaaattctgtagaaatcaggcagacagaaacaaatatgttccaaattttgttcataggagtatactttactcaactgttaaaagctgtaagtagcttaaaaggaaagtttcttgactctgaaaaacaaaacaaaggatcagcaacgttttaagcaaaaagataaaacacagttctattagttcagtacatgcagttaattcctattctgcttgatattcataaacttttccactctccatcagtcctgaaagtttttcctctagtttgacgtcacaatctccaaagttaacagaagcgtgcattcaagaacacctgttagaattttatagctgattataaaaccaccttctaaagaggactgaaacaagacaacaattgtccttggatgacaaaaagttttagggaagccatagtcaaagacacaattaacaaggaaatttgttatctctgtggcacacaataatttaacataacaattataattattactgataatgtacagtaagtcatatcagaattataggagtttcccataattttggaacacataccaataacacatttatacaaatacagcccaaagaaaaccaaacaccatattatatttgacaatgcttcctgtataatttctataccaaataagccaatatgttattatttggactttagggaacctattaataatatcttaaaggattaattaggtcagaaaaagatataatttataatttcattttggaaagtttgtcaaatatcaagggtttaaagcacttgatattacttgatgttacaaaatagaattacaggtcattgtaaaataagtcattcatttaatcaaagttataactcaatgattttttttaaaaaggtaaaaaccttcattttttgggagaggagacttaattttacaaacagtaagccctgataaaaacagcataaagccaattaaatttgttttccaaaattttataaacaatgtataaagttttaatcttaatcataagatataagcctttataaccttcttttttgtttgtttgtttgtttttttttttttagatggagtctcactctgtcacccagcctggagtgcagtggtgtgatctcagcttgctgcaacctctgcctcctgggttcacaccattctcctgcctcagcctcccgagtagctgggattacaggcgcccaccaccacgcctggctaattttttatatttttagtagagatggggtttcactgtgttagccaggatggtctcaatctcctgaccttgtgatccgcccaccaccacgcctggctaattttttatacttttagtagagatggggtttcactgtgttagccaggatggtctcaatctcctgaccttgtgatctgcccacctcagcctcccaaagtgctgggattacaggcatgagccaccgtgcccagccagactttataacctttataactttcattaaggagtcagttaaagcttcaagaaaaccttgtcaatcggacacagggcccatatgctggtcttgcatctgtgtgcctttgacattaatgtttaatttatagagaaactgaactttttatctcccaaaatcagcccttaccatctcacacacccacctcttctgtgatagtccctgggccttgaagggtaagatagctttaatttgttgccctgtgtttcatgaaggcagcttattttgcttctaccaggcttaaagatgaggattcaattgctgtcagtgtttaaagtttagcaggtcttggtgtactttttatacccaggagtccaagccctgtaactcaatgtcacaagcactttaaaagcacatacaggaagatacaaggatgtaataacctcaattaaaatttttttaaatattagttcttcctaagcaaaccaaacttaataatgatgtcataggaattgttttaataaaatgtaaaatctgttaggccagttaccaaaaggcaaaagaaaatacattctgcagtgcacagaatataatgttggaagaaaatatttcccgtagacctttaagaaaacattggtagcatcaggccacacacacacacacacacacacacacacacaaaaacagaacctgaggaggaagaaaaaataaaaaacttatatgagctgaagatgagttgatggggagtgttagtgttttgcaactttaaaaggggagagaaaaccaaaactagtgagatgcaataaaatttaaacttgaggttaaaataaaaaaaacttgatatctcttataatttattgagaataaaatcaaccccttaaaaatttcattactctgaccaattctttagtgcataagtgcttttttttttaacatcaaacccaatctctagaaaggctatcctaatttccatttacttggtcatgtacaagttgtttttttgtttgtttctttaataaatcatcctattgtggcttatgcagaccgttcatgatatccttggactttctggttggtcctgagcatccatctttcttaaagaaccattcatttcactctaggactaaatttaccatgcaagattccttctcatatgaaattatttctatttaagctttcttaccaaattaaacctctttatttattttttaaattatactttaagttctagggtacatgtgcacaacgtgcaggtttgttacataggtatacatgtgccatgtttgtttgctgcacccatcaacccgtcatttacattaggtatttctcctaatgctatccctcccatagctccccattccctgaaaagccccagtgtgatgttacccaccttatgtccaagtgttctcattgttcaattcccacctgtgagtgggaacatgtgatgtttggttttctgtccttgtgatagtttgctgagaatgatggtttccagcttcatccatgtccctgcaaaggacatgaactcatcctgttttatggctgcatagtattccatggtgtatatgtgccacattttcttaatccagtctatcattgatggacatttgggttggttccaagtctttgctattgtgaatagtgccacaataaacatacctgtgcatgtgcctttatactagcatgatttataatcctttgggtatatacccagtaatggggtctctgggtcaaatggtatttctagttctagatccttgaggaattgccacactgccttccacaatggttgaagtaatttaccctcccaccaacaatgtaaaagtgttcctatttctccacatcctctccagcatctgttgtttcctgactttttaatgattgccattctaactggcgtgagatggtgcctcattgtggttttaatttgcatttctctgatgaccagtgatgatgagcattttttcacgtgtcttttggctgcataaatgtcttcttttgagaagtgtctgttcatatcctttgcccactttttgatggtgttgtttttttcttgtaaatttatttaagttctttgtagattctggatattagccctttgtcagatgggtagattgcaaagattttctcccattctgtaggttgcctgttcactctgatggtagtttcttttgccatgcagaagctctttagtttaattagatcccatttgtctattttggcttttgttaccattacttttggtgttttagtcatgaagtccttgcccatgcctatgccctgaatggtattgcctaggttttcttctaaagtttttatggttttgggtctaacatttaagtctttaatccatcttgaattaatttttgtataagatataactttgtttgcatctcttttatttcctgattcctgttaccttgttttatacgtgacctttaaataagctttgatttagacaaaacttgttcatcttttttaaaaggaaaaacatttttttgggaagaattttttcctacaaatatatttttattggaaaatgcccaaataatgaaatatattatttaatttaatattatcttagattctaaattatgacacgtgtgtctataatatttatccaatgacatttacttaattattttattttaatcattcacctagcttatttataaaaactgcaattgtcattatttaaagttatggaaactccattgcaaaatcacaactgagacagtgaaaaagatttgatctaactgactccttcttgcttctagcctccaagctgtccttgttcattcctgggcataggtcaacctaactttggaaggaacttagtttgtagtttagatttgagacaaagacaataacagttctttccccaaaaaaccttactccctgtggactagactgcctaaaaccacaagattagaaattatggtaatcttactaaatttaagatgtagctatttttattgaaccaatatcgatgtcttatttattaaagattacacaagcaaagatcattccatcttgggctgggtttatagtttcgtaacccctgtgtcaaattttgtcaccttatagtatttggcagtgataagtatgaaattgcttgataaataaatgcaaacaaaaatatatgctgacaagacatttctgatactacattgccaataattttaaagctagcttatttactaaagattttagttaagttacttaaacttgaaaaagcatttgaccagtcttttcttttttttcctgataaagtatttgattcaagcacttttattttcctaagcccattaattagaactcttgtatgtattttcagtagtgaaacttagcatacacagcacataaatacgtagagatattaggcatgtcattagaagtactacttacagatttataaaaatctttttttttcctatcttagactttcagattctggataacctacttcagaaccctaggcagttgtgagctaaatagtcttaaatttgcatattaggccgggggtggtggctcacacctgtaatcccagtactttgggaggctgaggtgggtggatcacgaggtcaggagtttgagaccagcctggccaagatggtgaaaccctgtctctactgaaaatgcaaaaattagctgggtgtggtggtgggtgcctgtaatcccagctactcaggagtttgaggcaggagaattgctttaactgggaggcggaggttgcagtgagccaagattgtgccaccgcactctagcttgggcgacagagcaagactgtgtctcaaaaaacaaaaccgaaaaatgcatattaaagcaaacaactcaggtgaaaatcaaatagcaaaatttataccataaggcacagagttaaaaatgtctagtagtgacagagggagattaaagatggataccaaatcaaacataaaattatggaaatctatcataggatttaataaggagaccaattttatttagatagggaatacctatattttaactggatctctgggctttggccagatcccacactgaatcctgggtctccaaaaagggagaattactaagttagaccatgtgatgcttttacagtgcacttaattttttttaaacaaagacgaacttgtctgtttacattcttggggttccataaggcaaaactggtttctcccccaaagggggtgtggtatcttctctgttttctttaaggaaccccaggctgttacaaattattttaggtccaccgtgcagcagagggtgcaagagaaacgagagacagcggaagtaaatggagaaaacataattcagtcaactgagaagaaaaaaaacttatgctcaaaaaaatgacaaggtcctaggattaaaaacaaaaacaaaaacaaaaacatgaaggtcttttaaatacaaacacacacatatgcacacatacacacacacacacacatcttggatgttagcttttaattaagctgacttttaaccattgagctcttaaaaaaatccttttaaatctcattaccatatttcagctaggacaaattgctgcaatttcagaagtacagctattgctctttcagtttggcctggttagcaaaaaggtggccttgttatgtaaacaaagccttttagtagaaaaaaaaaaaaaaactttcttcttttttttgtcctttttctggccgtttttctcccccccaccacaccaactttttttgtgtgtgggaatttagccgtttcagaggccttgttccccataatttggaacttcctttggatttggtcaagccggatagagttgatgaaacccagtgggagaaagactgaaacaacgacaaaaacagaaaccaacaacaacaacaacaacaacaaaaaagttaagcaaaacaaacaattgcacaacttttatgattattgagcactctaatggtaaggagaaactaagaccagctgggttgttaatcttaactttagccaagacaaactcaaattctgttacttacctagggacgggtctcaggctgaagactgctctctaccatcctagaagcaggaataaaaaaaccaacgaacaaacacaaacctcatcttccctgttggaagtgagctcaaactccattaaggagtttcctgccttccatcatcatgatagcaggaaaagcttgcattccttatgttggaagcaagaacaactccaaagaaaaggggttgtacagcaaaataaactttagatctctatcaaattttaggagatcagagtctctgggggggcgtgatattgtttggctgtgaccccacccaaatgtcaacttgaattgtatctcccagaattcccccgtggtgtgggagggaccgggggaggtaattgaatcatgggggccggtctttcacatgctattctcataatagtgagtaagtctcatgcgctatgacgggtttatcagaggtttctgctgttgctccttcctcattttctattgctgcctccatgtaataagtgcctttcaactcttgccattattctgaggcctctccagccatgtggaactgtaagtccaattaaacctctttttcttcccagtcttgggtatgtccgtatcggcagtgtgaaaacagactaccattgtaaattggtactagtggagtggggtgctgctgaaaagagtcctgaaaatgtggaagtgactttggaactgggtaacgggcagaggttggaacagtttggagggctcagaagaagacaggaaaatgtgggaaagtttggaacttcctagggacttattgaatggctttacacaaaatgctgatagcactatggacaataaaatccaggctgaagtggtctgtgatggagatgaggaacttgttgggaaccggagcaaagacgactcttgttatgttttagcaaagagactggtggccttttgcccctgccctagagatttgtggaactttgaacttgagagagatgttctagtgtatctggaggaagaaatttctaagcagcaaagcattgaagatgtgacttgggtgctgttaaaggcattcagttttataagggaagcagagcataacaaatttggaaattttgcagcctgacaatgtgatagaaaagaaaatcccattttctgaggagaaattcaacctggttgcagaaatttgcatacataatgaggagctgaatgttaatccacaagacaatggggaaaatgtctctacagcatgtcagaggtcttcacggcagcccctttcatcacaggtttggaggcctagaaggaaaaagtggtttcatgggccaggtccactgtccctgtgctgtgtgcatcctagggacttggttccctgtgtcccagctgttccagctgtgcctgaaaggagccattgtaaagctcgggccatggctttagagggtgcaagccccaagtcttggcagcttccatgtggtgttgagcttgcagtgcacagaagtcaagaattagggtatgggaacctccacctagatgtcagaagatgtatggaaacgcctggatgcccaggtagaagtttgcttcaggggcagggccctcatggagaacctctgctaaggcagtgcagaagggaaatgtggggttggattccccactcagagtacctactggagtaccacctagtggagctgtgagaagagggccattgtcccagaccccagaatggtagatcctccaacagcctgcagcatgagactggaaaagctgcagacactcaacaccagtttgtgaaggcagccgcaagggaggctgtaccctgaaaagccacaaggtgggagtcgcccaagatcatgggaacccacttcttccatcagcgtgagctggatgtgagacatggagtcaaagaagattgttttggagttttaaggtttgactgccctgctggatttcagacttgcattggggcctgtagcccctttatgttggccaatttctcccacttggaatggctgtatttacctaatgcctgtacccccattgtatctaggaagtaactaacttgcttttgattttaccagctcgtaggtggaagggacttgccttgtctcagaagagactttggactgtgaacttctgagttaatgctgaaatgagttgagactttgggggactgtgagaaggcatgactggttttgaaatgtgaacatatgatatttgggaggggccagggatggaacgatatggcttggttctgtgtccccaccgaaatctcatctcgtagctcccataattcccacgtgttgtgggagggacccagtgggagatgattgaatcatgggggtgggtctttccagtgctgtcctcctgatagtgaatgggtctgatgagatctgatggttttaaaaatggaaacttctctgcacaagctttctttttttcctgccgccatccatccacataagatgtgatttgctcctccttgtcttctgccatgattgtgaggcctccccagccatgtggaactgtaagtccattataaacctcttttgtaaattgcccagtctcaggtttgtctttatcagcagcacgaaaacagacgaatacaggtagaaaagaaacaaatggttgcattattttgagtttctgattaacctctccaaatgagacaatcagatatgcatttatctcagtgagcagaggggtaactttgaacaggatgggaggcaggtttgccttacacagttcccagcttgactttcccctttagcttactgattttgggggcccaagatattttcctttcacaggtatatatccagcagtcgattgcttgatcatatggcagttctattttaagttttttgggcaatctccatactgttttccttaatggttgtagtaatttacacttccaccaacagtgtataaggatttccttttcactgcatcccaaggaagttactttcaatttggcattcgagaaaggtctcgttaagaaggtgtcacttgaacagaactcaaggaaagtgagggagtgtgctctgctgacgtctgcagggagaatgtctcaggtggagtgaactgcaagtgtgaggtccttgttcttcctgagattgagggacagcaaggaggctggggttgtgggaaaggagtgtccaggagggacagtgacaggagaggggaggccagcaagacagtgaggtccatagcatggagggtctttggggccacgataaaagtttgggtatctgctctggatgagatgggggtcactgaggactgtaagcacagaagtaacatgatctgacttgtgttttttaaaaaatcactttagcagctgtgtggagattagattgtagagggcagaagcggaggcaggcagctgaggtgaaaagccctctctctgctctgtgcttctcagtgagaggtgaataggacatgctcaaacctgagccctgctaagtcacgtgaatggctgagcaggctgggagagatgctatcagtagaaagagacacttttatgctttttttctgatgatcttcgcttttgcaagttcttttatttgcctaggagtgagagaggatggggaaaagattatcatcctttcccagaaaagtcttaaatatgactcccaagaatgtgaagctaggaagcagaggtcaccagacatggtcaaggctgcagccttggcttttacttctgctctgccatctcttgctgtggcaccctggacaagttactgcccctctgaagacatgatttctcgtccttgcccaggttgtgggctgagtgccagagagtgcctgcagccaggatgagttttgcacttggcagggcagtgcgcttgtgctatgtccctgctgccactgagtactgagctccctgtttcttctcctccaacctctgtaggcctactaaggattgggctgctgttcttgggcaagcaaggtgctgctaggatctgggtactgataggactgaggccaccccagaggcttagcagcctggagcaccaggtcttcatttaactcctccttccacaaagaagacctatttggagactgaagacacctgcagggtattaacaagacttgaaatgctgattaataataatatcagctgataatttgatgcttattatgccctggacattgttaaatgctcataaaccgggattccataaaaaaattaatacagaaaatgaaatgcagtagaaatacctggaaaagcaaattagagaaaattaaatgaaaatgatcatccatactccatgtcctatccatctggaatcattaattctcctatcatttccacagagcctactctgggccagccatcttagatgccatctctgtggtcccatcttcactggaaaattttagaagtgcagaccaggcacattggaagtaagttatttgggttgttcctttgactgtgcttgctgccggtcactgaccatctgagccagtgccctggcgttgaaccagccttagtctctcccaaaggtttctatccactggccacctccccacatttctctgctcccctaaaatgaatgagaaggacttactaaaggtactcagcaaggccttgccaaagttacaggtgtccccttccttttctcactaatgctaccctagctctccagcttcccttttgggcatgtatggagggttcatgtttcagtttcttctgagcatttagctctgtgctagtgcttgtgggaggattcctgaaaagtaacacaaatcctgaggtctggattaactagaggggaccaaaaggaagggggagaacagcatccatctgtctgcaaatgggagacagaggtgcctatggcactgctcctctcactgtaattacaccctgcagactgaaagaagccttcctgccaggctccccactttggggaaagagcaccttacagtgaaagtttctgtgacaaaaagaactagagcaaagaaaaaaagtgtagatgatgatttcagaggctggaaagcatagagaaaactggtttaaaataggttttctgttgagtgtcactggtggttaataaagtagaacactggactgcatgcaaacctctgtgctggtaatgtctcacccatggggaagaggtggctctgagcagtctcttggggaaaaaaaagtcccatctgctgaggcccagcagcccgaattccttgtagaatcgttctcaacaaaatactacataggcttcttcccctgtctccactctctataggcccagggccagtgatgtgaaagcctgacatcttgaaattaagcttgtgggcccatggctgttagttctgaaccagtcccaacagattgggtatagtggaagattcaacccagatgcatgcacacgcacacacacacacacacgcacacacacatatatatggagagagagagagaaagagaagagaggagacagagaaagaggagagatagaagagaggaatgagagagagagagatttatcatgaagtattggcttacaccattatagaagctgagaagtcccacgatctgtctgcaagctatagactcaggaacgctggtggtttggctcaaaagcctgatatctggaaagccgatggtgtgaattccagcctggatctgaagacctgagaatcaggagcactgagggcaggagaaatgaatatccccactcaagcagtcaggcagagagcaaattaaaccttcctctgccttttggctctatttggaccataaatagattagatcatgccgaccctcattggggatggccatctgctttacttaatgcactactttaaatgttaatctctttcagaaacaccctcacacacacgcccagaaaaaaaaaagtttaacccaatatttgggcattttgtggcccagtcaagttgacacacaaaactaaccatcacaaacatcaagccaggaatctaaactggagcccaacctgatttcatccctgactggatgtttggcttctgaccaatctttgctccatatccaagccttagcgtcattactagaacaatggggaggcagatgaggtggaatctgagggccttcccattctgcatataggatgctgggatgccaggagttagggacttccttatcttttttgccacacctgccaccctgcattcctacttcaagaaggctcagatgtgctggcctccagctcttctacagaaagcttccccttgttgggtccccatcaacccatcaacagctctacacagggctaagggaaagcatttaatcccagcaacaggtgtttgatctttccattatgtgtcctagtaattgcccccaaaggcctctcaaagctgctaaaatcatgctattagtttggggtgttttgccaataagaatacagacagaattgttgctcttttgctcttcaggctgtttaactgaagttacaccctagcagaaccagaatcaagactaagttcaggctgagagtctcatgaggtttgacatctgacaagtcttttggaactaggtgtagctgtatctgcggtaatgcactaattctgcccactgggtaaaaagcaaccatatccccatctgggctctgcactggtggtgcaatacagctggtcagattctaaagaatctcaagatttcacatgggccccttttcgagtggaaaggcccacattatcaattgcctgcaatgcacctggctgctcaacatacatgttgcacttcactgtggccaaacctgaccaaatcagccctccttactctactgctcctccagaattccccattttaagggtggtgctctcatcttcctggaagattcctgaaggcatcctgggaactgcctttatccttcctctccctctttgtagtttgaggacaaattctatccattctgtctcttctccaaccccagttccagtgctttagcctccctcaactctcactgaaatcatgctatcatcttcaaatggaactctctattttacctccacacattctgttctctagactgacttccaaaacacagatatttgtgactatcctgtccctacccacctccatgcaactcagacaccttcctttgctctggggcacatactaaataacagttgattgtgtggctgcacggtccttggtatgttgtccttagctgttgcatctcctcccttcctacctcttcaccctcaaacaccttagagttcttcccgtgccctgagcagattttgtactgtatcacttctttctcttgcttacacagttctctcaaagtggaatgccttgcatctaatctctacatgtctgaagaattgcatcttaaaagactcagctcaaatgctgcttcctccaggatactttgttgggttgcaatcctgttggttatttggctgctgtagtaatttgtagctcagaaaacttattactaatttccttatagaattattaactggccacagatctacttgcacctccaaactgtgagcatcaatagggcaaagatcaagtgtgacctatggcagtgtgcccatgcctaggagaacaatgaatacagactgcagatatctcggacattgaagatcaccaaaattctccagacaagaaccacgacccagcctggagtaatatccttttatgctaggttaattcaatttaggaccagctcgtgggatattagactaacaagtatgcaggtggaggcctgggggccacataaatatgcaggatggcttgccaaatctctgccccatcaggctatttacacaggtagttggaccctgcctacagatgaagcacagtgtgggcagagaattactcacttgttcaggacatagataagatccttccagaccagagagctgtgcttggcaggggtacaaatagcttcaatttcaaaatctttaatgactcaaccagagtaataacttagacctgcatcatagctgcctgctgtgagggccccaaagccccaagctttatgtctgcaatgagacttgtcctcagcattgaacctaaatcctcgaaacacccgacagaggcctgatgaatagttctagctatttgccctaaatgatgaatagttttagctatttaccctccccatcaggagagggagaacattgctaagcagaagacccaactaaatgaggtagagaagccctgggtgggcttctgggcagttcattgcctctcagagaccctgtggtgggagcaaaaaggtggcacagctgagatcacttcattaagggggaccacagcaaccatagctagaactcaacttcctgctgtaagttcagatatcccttgttctctgaagaactgctgtatctttcattgtctatgggcatctaggtgaattcaagaacagaaagcaaagtgaaacataaaacaacacattttccctaccagagacctgacctctcctttgttactgagataaaacaaaataccaaaagacttgcgtcccttccccaacaacagcagagagattgccaatgggtgagtcacagagagggcaatgaggtcatggaatgcatgctcattcccatgaaagcagaattaaatccatcctattggatggcccatagtatctttaaattcaacatattcaaattcaaattcatcttccaaatcttatgctccacaatttccctggtatctgaaaatgacaacatttacccaattattaaagccagtaacttaagattcctttatgactcctcaatcatcattctacctctcacctattccatcatgagttactttttagcctaccttctaaatctctctacaatatatctgcttactctactacttcactgtcactgccctagtccaagccaacatcaactgtggcctaaactacagcaatagcccctaattggccttactgcctctactctaatcccctcaaacctattctccattcagcagtcagtgtgcattttcactctcctacctcatatactccaagggttttccaaggtcctgaagtcttaaatttggaccatgacctacaaaacagtcgtactcagagttgcttaaaaagcatagccaaatatgaagtttacatcctaaggctttatttagcgattcagtcttgagacagcaagagtgatgtgaaaaagataagtcaggtaagaaaggtaggaaagcaaatatcaggtggcagactatgcagctgtccagaatttccaaagaaactcagcctgttgctcaggggcattaggcatctgtggacagttggaatggaaccaccttgctgcagaatagtcgattctatctcttgttgcttattgatgaaaattcaactcagaagctactaacctacctgtacattcaggttatgctatccacccttcaggtatccattatggaagtgagaccccatggtgcctaaggcacttcatctgagtctagaagtgataggagggaccagggcttctattggatgcagtaggatcaggcctgggtagcacaacacttgcaacttctaccacggtagactcagtggaggatacaatggagcctaaccctcaccttgaagtagaaagtgactaaaattactgacagtgctaggtaataaggcaatagcagtggcatatggggcttttcattgagaaaatgactttgtgtctggaaagtgggcagggctgagcaaaactggggtggcatataactagaatccaatacaaacagagagcctgattagaccagcttcatctgacgacatgtttcttgctttctacacttcggtctcactgaacttctgaatcctctagaagtgcactatgctatgtggctacataaatgtagattgattaaaattaaataacattgggacttccacttcttgccaagttaaagtaataaggattagatttattctcctgcctgaaagaacaaaatgtgtgaaacaatacttttcaggactctgtgcatcacgtaacaaagaacagtgatcctggagaaaagagaaacagttggtgagtactatgattttcccagcttattgcctagaaaatcttctaagatgtgatgcaaggagggaaaacccaggcaaagccttacagtatccctgaattgaagacttccagcttggattttgggaaaacaaagacagccagagcttgtagtgcagaatattggagagtagaaagatacacatagaaataattccagatgtctgtggagtgcccccctcaagtattcaacagaatactgatcagcacatgcatatgaggaaactattggaggctggggtaagaattatctaaaaggatgagagtgaaggacatagcactcacacaatctggaacagtacctgctgccaccagccagactagacaaattcgtaattcacctgacaatggatagagtacacagtattcttgcttcaaaagtgaggaattatgaaccctagactgagcaatgtcccactcccacctaataaatcaaaaggaccagactgtttctaattaacttaactgcattccagaatgaagattgataatgtttataggaattcaaaaatatagcacttgacaaggtaaaatctagcacctgacaaggtaaaatcaaaatgtctggctccaaacaaatattgcaggcatgcaatgaactagaaaaatccaaacaacagaaagaaaaattaatcagttgaaaccaacccagaagtgatacagatatcagaattagcaaacatggacattaaaagaataattataattgtgttccatatggtaaaaagttaagtagaaatgtgacagatataaaaagacacaaatcaaacttctgcagatgaaaacttaaaaaaatgagataaaaatgcactagatgagattaactaacaaattagatatttcagaaaaaaagaaaagtgagcttgaagatatagcaaaataaactatccaagatgggaagctgagagaaaagagaagttaaaaaaaatagcagagcatcactgagctgtagaaaactgcaagtgctctaatatacatataattagagtctctgaaaatgagaggcaaacagaaaaattatgtaacaaaatgatgtcctttttttccaaatttgatgaaaaatataaacccactgtgttagcccattttgcattgctaaaagtaatacccgagactgggtaatttataaagaaaagaggattattttggctcatgggtctgcaggctatacaggaagcatggtggtgccagcatgtgcctctggtaaggcctcaggaagcttacaatcatggtggaaggcaaacagggagccagtgtgtcacatgaagagagaaggagcaagagagagggaagagggtccaggttcttttaaacaaccagatcttgcatgaactcataaagtgagaactaacttaatactgtgaacacagcatcaaaccatttgtgagggattgttccccatgacacaaacacctcccactgagcccacctctaatattggaagtcacattccaacatgagatttggaggggataaaacatccaaaccgtatcacccaccaatccaaaaagctcagcaaacagggatcacaagaaacatgaagaaaattacaccaaggcacatcacaaacaaattatgaaaaacagagataataagaaaacctagaggagacagaaaagaaatatgtagcagaggaataaagataagggcataagatttttgttggaaataacgcaagtgagaagatagtgaagcaatatttttaaagtattgaaaacaacatgtcaacctaatattccacacccaggaaaaatgtcactcaaaaaggaagtgatatgaaaatcacatgatatggtatgatatgatatgaaaaatgaagcttttttcagacatacaaaaggtgaaagacatcagcactaacagatcatcccttctattcccagtttattaagtgttcttaccaagaaagggggctgaatattttctgcatctattgagatgatcatgtgattctagcaaccaattaatattatatattacattatttccagatattaaaccaaccttgtattcctgggataaatcccacatggtcatgctttataattctttttaaatgttgctggatttggtttgctattatgttgttggagtttttgcatgtctacatttataactgaagagaaagaaatactttccatctcaatttatgagaccaacattatcttaataataaaagcaaataaagacattacaagaaacgaaaactaaagaccaatatcttcaagtacataattttaaaaagaatcttaaaatatttttagcaaattaaaagccagcaacatgtaaaaaggatactacatcatgttcaagtagatttatcccaggaatgcaagtttgtgttaatgtttgaaaattaatcaatgtagtacatcatattaacaaatctaaaaagacccatatgatgacctcagcagaagcattcggcagtattcaaaatccattacttatgaaacctctgcacaaactaggaatagaagagaacttccacaaccagataaaagtaacttataagaaatcataatacattatgataaaggaatgaatgaccttgcttgaagatctggaacaagataaggagttcactttcatcacgtctatttaacattgtactagagattctaaccactgcaataaagccagaagaaaaataagggaagaagaaggaaggaaggaaggaaggaaggaaggaaggaaggaaggaaggaaggaaggaaggaaggaaggaaggaaggaaggcaggcaggcaggcaggcaggcaggcaggcaagcatgtagattgaaaaagaaaaataaaaaccctttatttgcagacattattataatctacatagaaaatctgactgaatcttgtttaaaagtctgaaactagtgtctttgataagtgctgtagtcagaataacagtcttctaaagatgttcatattctaatcttcagagcctgtgaatatgttaccttccatggcaagaggggcttggcaggtgtgattaagttaaggaacttgagataagaatattattctggattatcctggtgggcctaatgcaatcataaaaggaaagcaaaaggggcagagtcagaaagagagaaacattggaagatgttattctgctggctttaagatggaaactggaaccatgagtcaaacaatatgaatagcctctggaagctagaaaaaaaaggagattctcccccaaagactccagaaggagcacagtcctgatgacaccttgattttaggccactgagactaattttggaactctgactgccagaattgtaatataataaatttgtattgttttaagctaccaagtttgtgttaatttgttatagcagtcataagaatctaatatagcaagtttgcaggatataagatcaataaacaataatcaattgtagatgtatatggtaatgataaaaaagagaaattaaaatttaaaaatactgcatacaatcacttcgaaaagtatggaatacttagggataaatctgacaaaggaatgagacacttagacactgaaaattacagaacattgctgagaaaatgaaataccaaaatagatatactgtgttcctggatcagaagacccaatatcattagaatgttaattttcctaagctgttctatagattcaatgcaattccaatcaaaaatcacaaaacacgtattttgtagaaataggaaatctgatgctaaaattaatatggtaatgtatgcacctagaatacccaaaacaactttgaaaaagagaagcaggaaaatacccatctaatagcagattaataaccagaatatataaggagttcaaaaaactcagtctaataatccaatcaaaaatgggcaaaatatttgaatagacatttctcaaaagaagacatacagatgggaaacagacatatgaaaagttgctcaacaacattgatcaccagagaaaaacaaaccaaaactacaatgacacatcatctcataccagttaaaatgacttctatccaaaagtcaggcaataataaatgctggagaggatgtggagaaaagggaatctttgtacactgttagtgggaatgtaaattagtacaaacactatggagaacagtttggaggttcctcaaaaaactaaaaattgagctaccttatgattcagtaatctcactgctgggtatatacccaaaagaaagaaaatcagtatttcaaagagatatctgcactcccatgtttgttgtagcactatttacaatagttacaatagttaacatctggtagcaacttaagggtccaccaacagataaatggataaagaaaatgtggtatgtatgcacaatggagtactattcagccataaagaagaatgagatcttgccatttgcagcaacatggatggaactggagatctttatgttaagtgaaataaaccagacacagaaagacaaacattgcatgttctcacttatttgtgaaatctaaaaattaaaacaatttaactcatgagcatagagagtagaaggatggttaccagaggctgggaagggtagtagggggctggggagaaggtagggatggttaatgggtacaaacaaatagaaagaatgaataagacctactatttgatagcacaaaagggaggctatagtcaataataacttaattttacattttaaaataaataaaagagtgtaactgagttgtttgtaacacaaagggtaaatacttgaggggatggataccccattctccatgatgtgattattttgcattgcatgcctggatcaaaacatctcatttacctaaaaattatacacctattacgtacctcaaaaaattaagaattaaaaaacattaaaaagagaagcaggaactcatatagtcctttgagaagaaagagttgttgggatcttccaagtgggacctttagcagtgggtgagcacaggttaacaatgcctccaacatggctttctgggtggttggtaacccttcaagtggcaattcagtttaaatcagcacccacctgtcccattgcaaccccagggtcatgtttacattacctattggatggcccacgttagtcaccctttgaaagatagcgggagaagaagacgagtttaccaaggctgctgtgatttgtgctagaagaagaacaacaaattgctcgtcactaaggaatatattatagactgatgaatctgccatggatgcataattattgaaaagcaaaactctccaagaatcagctttttacgaaaacaacatatgccttacttctcccagggaaatggcaggaaaggcccctttggaagtgtcccccaatttccttgcatactatccaaaggaacaaacagagggagtgggatacatgtgtgggaggagacacgtgttgtcctactccgccctttcaattagatgtattgccagtttagtttgtgtctgtgtaaccatttctgtatcacttgaaaactgctggatgtattgccatgcagtttaagggaagtttggagaagttataggccttgtacgatgcataaagattgccttgggtggtgattagtacatagtatctagtgattctaagaggcattgggcagagagtgtccccaaatatcattctccaatgaaaagtccctagggtggaccctccccattacaaatgatttttcacccagtaatgggtgaatgagcctgagtgacaccaggatggccaaagggtcaatacctaatgaccaccgtaccccttgctggttatctgctatgtgccagccatggagacccttctctttacctcagttctgataagacaacatcattaactgtgcttgaaaaataagtcctcttcagaaaagactctcaaacctggactaggctgagccaaaatagagagcaacgtcaaaagggctggggtcgagtttagcatggcatcaagtctcatttgaatctttgtgtctgggttgtgtggcttagtacttgtccaggagccatctttcccaatggtctgcaaccctcactgtggctggcaaaaatgtctggctggtccacaagtctcccagagtccagcctgacatctggcacatagcagaggttcactgtttaatgagtgaacaagttgcaggttcctcatctgtacaatgaagataatgatttctgagatgcctaccttaccttacagtgttgttatgtaccgaagtcagagtgataatgctactgaatataaggtatcctcataattgtagttttcacacctactgtgtccaatcaatgtcacatacaatgcctacatcaagactgagcccagtgtatagtcatttaataacttccaattactgtacatccactagaatggctactaaagacctatttaaaagagtgataacaagtgttggcaagaatggggagaactggaaccctcacgcactgctggtaaaatgatacaaacactttgtaaaatagtttgatggtttctaatacagttaaacatagagttaccatatgacccagcaattccattcctagatatatatccaaatgaaacaaaaacgtatgttttcacaaagacttgtactcaagtgttcataataacattattcatatagtctcccaactggaaaaatatgttcatcaacaggttaatagataataaagtgtgacatgatgcaataaaaaaaatgaaccactgatacattttacaacatggatggcctcaaaaatatgctgtgtgaaagaagccagacaaaaaatacaaactgtatgattctacctgtatgaaactctagaagggacaaatataatctataggaacacaaatcagattattaaatacatctaagaatggggcattgaatgggaatggacattagggaatgaatattttccctatcttgagctgagttatggttatacaggtttatacctatataagtattcacttaatgttcgtatgctgtcctatatgtaagctacgcctctcaatatttaaaaaaaaaataaaaaagaaaatgtctgttctcaggcaaatcaggaaaatatatagtgcaacaaatacagtcttatagtttgctatgagcgtggcagtattttaagtatcttacataaattaattcaagttaattctcacaataaacttataaggaaagtactatggttattccagtgttacaaagtagaaactagatttgaagaagttaagcaacatttcctgtgtcacagagccaataacgagtctagtggagatttgaacctgggtctgtgtggctccaaagcccttaaccaagaaacaaatttgattccccaacagctctctctagtgaatggggatgagttagttgtgataggctgagcactccagaggaaattgaccagatggctgagggccccagaaagctttgggcaggtgaggtgaggagatttggtgactggctcacagtccccacagggcaagactgaagcagagggcagagatttgttctgaagggctctagtgggctgtgctgaggccagggaggcagactgccactcaaccaaagcaatagcacaggcagagtgcctcccactggaacaggatgtcctatggtggtgagcaacctgtcacgcaggtcagccattggatagagacttggggaagttccacacacagtgattaagacacaaggcaggcttcaaatccaggctttgctccttctagctgggtaatctttgggaagctacacaggttcactggggccagttttttatctgtaaagtggaaatactgtcagtggcttcccgccgtaagtattaaaggagacaatgcatgcagagtgcatggctcagtgcctggcacgctaaatgaaggtgacctgctgctgttgttgtcatcatgttgtggacaatattggactagcatctaaataaaaaactcagtaacttagtaacaaagcaatggctaatcactttaaaacaaaacaaaaaaaatcctgaaaggctttctgaaatccaagcagctttgacttcgtcttgagggcactcttcagtaggccaatgatgtggttgtattttcattttcacatgttcaccctggttgccatgtgaaaagtagcctgaaaggacaagagtggaggcagggagacttgtttggaggctgttgcaattgtccaggcaagtgtcaataggaattggcttgctgtgcatgaagagaaatgaaggacagccaaaactggctgcatctaaaaaggaggaagtgtttcccctctttgacatgcgcaaaggcccagaacaccccaatgggcgctgaggaattaaatcagggttccaggctctagccctgcatcagcatgctaaggagtcagccacagatgatggagtaggaacatgatcggaagtgacaggcctccgtctgcagggccctacactacccactgaggctttaatcatgaacagttgattctaaatggctgccaaaccgtctgttccattcagggccacagcttccaatccaaacctgaacactccacagagctaatctctccaacctacccagcacactcaggggcaaaatgcaggggagaaggactggccccaggcagagaaacattgaacagaaccctgagcccttctgtggacacagtgctttacaatttacaaggcaggatcacatctattatcctcggggtttgtacaagcacttctcccacttcacgtcaggagcttgacttgggggaaagttcagttttgtaacatgtgtgatgttatctgtggctttttttcacagaatgctttatcgggtagaggaagttcctttctactcttagtttgttcagtgtttttattataaaaggatgttatactttgtcaaatactttttctgggcacaaacaagatcatgtggggttttttccttttattctattaatatggtgtatcatattgaatatgataccatttttagatatcaggctagtaaaagtaagcaatagcttctttaatatatatttagaaatatgtatttcaaaacttaagaaataaaagacaagtgtatgataaccagaaagttggtaccactgtaaccagaagtaccactgtctctgttatggggaggaaaaccagagatgagctagggaaggagcacacggttggttgccatggtgtcaggcgatgctcttgatcttggtctgagtggttggttgacgtgttttacattcccataagcaatataccaggattgcaatttctccacatccttgacaacacttttttctttttaaaaaagaaaaaaaaaaaaacacagctatcctggtaggtataaagtggcatctcgttaagattttgattttacattttctttttttaaccttaaattcgaggtacagtgcaggtttgttacaaaggtaaacttatgtcatgggggtttgttgtacaaattatttcctcacccagatattaagtctagtacccattagttatttttcctgatcttcctctcccaccctccaccctctgaaagtccccagtgtgtgttgtttccctctatgtgtccatgtgttctcatcatttagctcccatttataagtgagaacatgtggcatataataattatacatattcatgaggtacatagtaatgtttcaagacatgtagagtgatcagatcagcataattagcatatacacaatctcaaacatttatcatttctttgtgtgtggaaacattcaatatccctctcctagctatttaagacgatatattattgttaactatagtcatcttactgtggtatagaacactagaaattattcctcctatccagctgtaatttcgcatcttttaacaaacttctgcctacccccacccctttcttttacccttctcagcctctattctactttttacttttataagataaacatttttagcttccacatatgagtgagaacatgcattgtttgactttctgctcctggcctgttctccctaacatcatgtcctctagtttcattcatgttgttgcaaatgtcaggatttcattcttttttatggctgattagtactccatcgtttatgtgtatcacattttctttaccaactcatctgttgttggacacctaggttgattccatatcttggctattgtgaatagtgctgcaataaacataggggtgcagatgtttgtttcatatactgatttcatctcctttggataaattcccagtagtgggattgctggatcatatggtagttctatttgtagttttttgagcaatctccatactgttctacatagtggctatactagtttacattcccaccaacagtgtgtaagagttcccttttctctgcatccttgccagaattttttttttgtcttttttatagtagccactctaacagatgtgaatgacatctcattgtggttttgatttgcagttcacttttgattagtaatgttgagcattttttaatctatttgttggccatttgtatgtcttcttttgagaaatttctgttagatcatttgcctatatttaattggatagttcggcttttattattttgctgttgaattccttatatattcgggttattaatcccttttcagatgaataatttgctaatattttctctcattgtgtaggttgtcttttcactatgttgattgtttcctttgctgtgcagaaggcctttggtttaatttaattctatgtgtttatttttgctttttctgcctatgcttttgaagtcctattcatagaatcttttcccagacaaatgtcctaaagaatttccctaatattttcctctactagttttgtagttttaggtattacatttgggtctttcatccattttgagtgatttttgtgtaggatgagaggtgtgggtctagtttcattcttgtgtgcatgggtatccaattttccccagcactatttatggaagaaactggcctttccacaacgagtgttcttggcacctgtgtcaaaaatcaattggctgcaaatacatagattgatttctgggttctctattttgttacattggtctatgtgtctgttttcatatcagtactatgctcttttagttactatagctttgtagtatattttgaagtctggtagtgtgatgcctccagctttgttctttttgcttaggattacattggctatctgagattttttgtggttctatacacatttaaatattttgccctgtttctgtgaagacagtcattgatattttggtagggattgccttgaatctgtagattgctttgagtagtatggtcattttaacaatgttaattattccaatccataagcatggaacaaatgtctttccatttttttgtaacctcttcaatttgtttcatcagttttttttttttttttggtagttttccttgtagaggccgttcacctttttggttaaatgtattcttaggtatatatttttgtacctattgtaaattggattgccttcttgttttcttcttcagctagcttgttgttcatgtatatcagtttactactgatttttctatgttgattttgtatcctgcaaatttactgaattcatttatcagttccaagaggtttttggcagagtctttaggtttttattaatatataagatcgtgtcatctgcaaacagggacaatttgacttcctcctttccaatctggattccttttatttctttctgttgcctacttgctctggctacgacttccagtactatgttgagtaacaatggtgaaagtggtcatccttttccttttccagtttttaatggaaaagctttctgtgttttcctgtccagtttgcctatttttaaagtgggtttttgtctttttgttgttgcattgtaacagtgtattatgttgtatattctggatatcaaactcttatcagatgatatatgacttgaaaatattttttatcgctctgtagggtgtcttttcactttcataatggtgtacatgaatgcataaaggtttattttaattttgttgaagtccaatctatctatttttttgttgctgttgcctgtgcctttagtgtcctaagatgctaataccaaatctgatattataaagatttattcttatgtcctcttctaaaaagtttaagatttatcacttacatttagaccattgatcaattttcattaaatttttataaggtgtgagatagtgggtccacattttattcttttgcatgtagaaatctagttgttcctgaatcatttgttgaaaagactattgttttctcattgaatggccaaatttcaattggtcataaatctatttctggacctcagttctatttcattggtctatatgtctatccttatgtcagcaccacactattttgattactgcagctttgtattaggttttgaaatcaggaaagtgtgagccctctaaattgtttttctttttcaacattcttttggctatttggggacccttacaattccgtgatcagaagtgacaggcttccgtctgcagggccctgcactacccactgaggctttaatcataaacagttgattctaaatggctgccaaaccgtctgttccattcagggccacagttgggatcaactttactctttcttcaaaaggtcctgttagaattttgataaagattgtgtagactctatagattgctttgggtagtattgccatcttaacgatattaagcctcctcattaattaacacaggctgactttctatttatttaggtttttaatttctttcagcaatgttttgcagttttcagtcagttcgcagtttgcatgcctttcatatgctaagtttaatttattgctttgaactggttattgctggtgtatagaaacaactggtttctatgtgttgattttgttccctgaaacttggctgaatttttttattagctctagaagctttcttatggattctttgggattttatatatataagatcattacatctgtgaatagagatagttttacttctttctttacaatttagatgtcttttttctagccaaatttgtctgactagaattttacaaaagcaatgaagtacgatttgataatcaagtagagacgtcaagttggcaatgggatatgtgagtgaggagtttaggggagaggttcacactagagatataaacttggaaaccataagcatatagataatattgaaagctataaaactggataagatcgccaaggggtacagcgtaaagagaaagactagaagagtccaagtaccgagtcctgggtcactccaaatctaagagttttggaacagaaggaggatctggcaatagaaattgagaaggagcagacagtgaggtaggaggaaaatcaagaaagtgagatattacagaattcaaatgaggaaacataccataacttgttaaatctaccttataaataaatattgaatctgtcctcttctgtcaatctcggcccctactatcgaagtccaaaccaacatcattacttgcctatattgccataattcaccctaacttgtctttctacattcaccctttactccccccaagtacattaatagctctgcatccagagtgatatttctaaaatgtggatttttgtcatgacattttcttcttttatattctccaatggctccccattgattatttattttggttcttcattgtatcactctatgtcttagaacatgttacttccctctgcatggaacactctcccttgcctctctccacacttttctcatctgtcaattcttagatcctctaggtgggtgtttccggctccctcccttcctgtgttccccattctaccagtttatctagaaggtagcactcatcacactcttttgccaacgtctgctgtctctctcctttataagattgtgatctctgtgaaagcagtggcttctatatattttgttcaactgctttcctttagtgcctggcacacagattatgttctatatatgtttgttggatgagtggctccgttccatgaatgcatgactgtttcccaagagcataaggtactgagttttgcattctgtgacaatattcagtgtggatacatgttttaaacttgatttgcctcagagttatattcttctgacttctcatttatgatccatcactgtgttgcacaataataagtatgcattaaaactttaacttttctgttgaaatgtaccattcacaatagacaaagatgagaaaacaacaacaaataaccattaactgatgaatgggtaaagaaaatgtttatccattcatgcaatggagtattatttggccataaaagggaatgaagctctgacacattctgcaacatggctgaatcttgcaacacattatgcccagtgaaatcagaagccagacacaaagactgcatgttgtgtgattccattcatatgaaatatccagaagaagctaatccgtagagacatatagcagatgagtggttatctagggctggagggctcaggggaaatggggagcgactctttaatagatacagtgtttccatttgggatgatgaaaatgttctgaaactagataacattgatgcttgcacattgtgaatgtactacatgcctctgaaatgtaaactttaaaatggttaaaatggtgaatttgaagttatgtgcattttaccacaacataaataaatacataggcagagaatcacatatagcaggtaacctttggtgccatttgtctgattgctgcacaaggttcttcaatattcagagcccattgggccccttgatatcacattttttctcttcctttactagctgtgtggccttatgggaattcacttcatttctctgtctctattagcacatctgtaaaatgggaagaataatagttgttccaccgaccttccaagggtcctgtttatcttttgggcaataacatagcttttccagacccttcggatgggaaagagaatatcagcccaaagagctcctggtcttgctgcagtcttgggtgagaatggctcagcaaggccagaaatagagcaaatgtttcatagggttctcatctgctgatctgtccttgcaatgctgtaccaccctcctacacacccaaatacctggcatttaaaccacacagggatacatcagcccaaacacatagagtgggtacttaagcattacaaaagggcagcatgttccagcctaagtagatcatctcacagtcagcatcctcagtgagccaccgctgtgaaggcagcgtgaatgcatcagagtcgggctactgtgttgctccttccctcactgagccatcaggaaacagaccataaagacaaaagtggcagggggtggaatgcacacaaggttgacctaaaagaggatcaggtccagtgtgagccacagagatactgacggggtcattctgaccattacaacctctggacaccatccctcttccaggagaaggccaggagtctctttttatgtaggagttactccagaacaacttttatttcccttaataagtttatacctaggccctttcccagacttctacaacttcttgggtcatccatatcaagacaagttaattgaactacatgcttcaaatggaagcatgctcatcgtcacctactgtaggtccccaaaggatcaaacttgttgatgaagatactgttggtgataatgataaacaacaataccatttctgccaatagctttcatttataggggtctaccttgtttcaggcatccagtggtttatatcttaaattctcacaataaccctatgccggaagtactattattagccgcattttataaatgaggatgattaggattagggaagtgattttcctggggtccacagttagtggatggcataattgggccttggaccacctgagtccaaagtctagggcccttccattgtacttcattgcctcttcaccttcccctttcccctatctgctggttctttcagctccccaggccacttccctttctcttagcttctcagtgaaactagagcagaagaaaagaaactggggatgaccatcacctcctcactgggcctcctgccctctgaagctcaagcccaagtcccaagatgggcttccagataatctcaaatagccttggggccatcccttcaaaaccctgcagcacaccttggactggacaccagtggcagctgaggctctgtgaacattcttagcctctcccaaattcagagagtttgaagtagaataaaaactctgtttttcaaaggtaagtcttctttggaatgtcagtcaatccttgattccaacacatgagcctgaactgaaggagatatcttactaacagctgcctacagctgggcagtgttctatagtgtctcccagctgtagagcaggtattagtaagataaacccagatccatactaaaggtgtggaggagccctggtgagctggaagtttcccatccccagctcacagaatcataatgtgatctgtaagattcctcaattcctgcccctgtgaatgctcaaggctcctccctcatctctggacttggagttggatatggtataaaacatgattcatgctatattttacggcaactcccaagatgtgaggtcagaggtgggggagattggaggcagagcagtcaactgggggctttaaaaagagtccatgaaaagataatgaattgataagacagatccctgagcctggtaggattcatacaatatggcatctgattgccaatcaggccctccatctcactgtgtccatccctactgctgtgcctttcagcatgcttgcgcctcctgctggcatgctttcccccatatctgcttctcaaaatctccactgtcttcccaatctatccaaaaggccaccccatccagaggcctagcttgctattcttctcctccttgtgcccagccactggcgattcttcctcactccaacccctaaagactgctctgtgtgctgctcacctggagtcccttacgactcctgtattagaattcccagtgcacatttcccactcccatgcaaagctgggagagctttgagactcatgcaacattggagtgctcagcactgggcctggcacaaagtaaaaacccaataaatacccattgacttcaatgctttgaatagcatttgggggctggcacacattccctactctccacaggcccactgagttttggctcagagggaaataatgtgtttgctcttcctgagttagctactggctgctgccatttcactgactgctgtcctcagtaaggagcccgcctgtccctcagttctgcagactgcttgcttggtcggtgggccttgggctccacatgcccactattgttcccctaatctaggcagcagtgccccatcacaagaatttgggccagtctcagttaaaagaatttacaattttggaaagtgatctctaaggagacagggtttgggcaagtgagagaaggggaaattagtggagagggagggagggaagtgggagcacagagaggagaaacaagagcaaagaaaagacaattctttgaaatctaagggccatgaaaaccatagaactctaaggcagagcactccaccccaagactttcagcttgatttagctgaagaattattgttctgtagaacagatacaagtgaaggaattcagctctctgcctttttgagctctctctcttttccttccatggcagcctccagggcccctatttgagactttgtgacccaggtcaaggtgaaaaaacaggttcagacataggtcatctctaataggcaaaagcagtaaggagcatgggccagagtttagctcaaggcacctggaggctcagactggagctctgaccctgtctggtgcattttttacagtgagcaaatcctctctatgccccctctttggttttctcacctgagaaatagttacacacttactttggctgcattctggagctagagaggtcatggggggtgtagcaaattcacaggtataaggtgctgaatcctggaggtaagttccatcagtggccttgctactgtggcttcatgcaagactgccctgcatagggtgttcaccttagccccagcccctggcccagagaagtacagttcaattccaagatcaatttgaaatgtatggtgagggtgtcccaaggcattttttgtttgttgtcattatttttaaattttaaaatatttaattgacaaacattgtatatatgtaaggtatacaacatgatgatttgatatacttatgtatcgcatactgattactgcagtcaaatcattaccactcatagttaccgcttgcgggaggggggcaggcagtgaggacacttaaaatctgctcttttaccaagtttcaaggatataatacagtattaactatagtcaccatacggtacattagatctccagcaattactcatcctataactgaaagtttataccctttgatcgtcatctcccaaatcccccaccttccagcccctggcaacctctattctgcttttatgagtttgatttcaacttttttagattctacatgtaagactttgtgtgcctggctaatttaacataatgtcctccaggttcatccatgttgttagaagtggtaggatcttctttatggctgaatgacatcccactgggtatatataccatattttctttatctgtttatccattaatggacatttaggttgattccatagcttggctattgtaaataatgctgcaatgaacatgggagtgcagatatctttatgagagagtcacttaatttcctttggatatataccaaaagaaggattgctgggtcatatggtagttcaatttttttttctttaggatcctccataggtttccacggttgctgcaccaatttacagtcccatcaagagtgtacaagagctcccttttctccacgcccttgccaacacttcttatctcttgtctttttgatactagccatactaacaggtgtgaggtgaaatctcatgattattttgatttgcattttcctgatgattggtgatgttgagcattttatcacatatccattggccatttgtatgtcttcttcagaaaaatgtccattcaggtcatttgcccatttttaaaattaatgtatttggagtttgatgttgttttgtgattttctttatgtttgtttgttattgggttgtgtaagttccttacatgtttcatgaataggtattgacctcttatcagatacgtatcttgtatttcattttgctgatggtttctttgctgtgtgggagccttgtaatttcatgtagtcccacttgttcatttttgctttttttgcctgtgcttctgatatcataccccaaaacaatcattaccaagaccaatagcaaggagcttttcccctatgtttgcttctagaagttttacacttcaggccttacttttaaatctttaagccatttcaaataaatttttatatatggcgtaagacaagggttcaattttccttttttgcatgtggatgtactgtttttccagcactatttattgaagagcctattctttccccattgcgtactcttggcacccttgtcaaagtttagttgataatacatatgtaagtttattcctgggctgtctattctgcttcattggtctacatgtcagtttttatgccagtaccatactgtttttattatggtggatttgcaatatatcccaaggcatttattgacacctgagagtggcatccaagtcagaagcacagtaggccttcccaggtttgggtacagtttacatttggctttggaggccactcactggatactgggcaatgaagctaagctgctgagacctcccagctctctgaaaagcttttccatctgaccatgtgcttaaggacacttcacttattcaggcctcatgtcctgatgagttcaatagggagggggcactgccctagctctggggtctgcactaaatctacatgttatgcatcctgctgatcaataaccttccccagctgtagcttcctcaactgtcctttcagtgactgatttctttagcagatagcaatacctgggctccatcctattgccacctcttcccctcccacctcccttaccgaactgctccctgatgattaagccttctcaaatcctagagagaactgaatgtgctcctcagatatatccctgcaagcctagatatgggtgctgagggtgtggaggccaggtagaagtccagccaagacctagggacatgttactcatgtcattacccctcctttggggccaattttgagaaggaataggaaacaggtgctggactgtggagaaaaattgctgtgaggagagtgatgaccccagagcagaggcagcaataatggagcacacacaagatagctaggcaggctatctcagggccttgtcttcctagtgtggggggtgggggacgagatcatgaaattagaggaggtggttgctgctaaccagccccttcagtggccccatcaaatctcgggcatccatggacactatgatctgtgtcccttgagtagttcaattccttcattccacaagtagtgattgagtgtctactctgtgttagcactccacaaagtcaacacgacagacaatgcctctgccctcatggagcaggcagtgcacagagcgcacttctacagcaaataaatgttttgaggggaactatgctctgattgagaacaaagagaggaagagatggtttactagtgtggtctggtgttcaggaaaccttcctgaggaggtgacatttgagctgaaatctgaaagatgagaagtaattagccatgtgagcagttagaggacgagcctttcaggcaaagggactaatatgtactaaggctatgtgggggatggagggtggtgaggaacttcacttactcaaggaatgaaggccagcaaggttttgtgctttgctagctctgaggctctgattgagacagactgtccacagcttagggagcctactaccaccactgtgaatcctagcattgtggccacgcacatcactctcgtactttctcccctccctcacccactgcaggacggagggcttcaggattcccctctttttcctctctcatcccagagcagcactgcagatccagaaaccatgagcacacccattcctttcttttgcctctcttcctggatgcaactgagtgctttggaaagcctcagaaatgtgacatgagaagaggtagaaacaacttacacatattggagaagagtctatttgcatttggatttccctgttcattatgcacacttatatctacagacagagctgacactatgctcctgaatattgggcccaccatggtgtctttactatatttgaaactttgccgtggttgctatgtccatttgcaaagattcaggtccgactcctgaggactcatggaatcaataaggaccccacccccacccccactcccacccccacgccacctctcgaaactgatggccaccagaaatccaagccctggcaggtggtagacacattacacattttgactcacccagacatctccccatgccagcattgttactgtcctctctctctctcctccttttcatcaccatgcaatggaaggagcaccgggccaggaatctagaaactaaaactatagtcccggctttgccactgaccaagtgactgactttgtgagtgtgggcaaggtatttcagcatgttcattgagcacttgctatgagacaaaagcaaagctgacatctcctggctacaattccttactctgtaaaatgggaacaatattatccaccttattaggctgttggtgatattatattgatgacagtttgccaagtgtcctaatattctgaccgactctgtaataaaataacttaaatttgcactgattagctgcttcatccagatttttaaatcaattatattaaagaataatttacataaaatggacccactttaagtgcacagtttgatgcagtctagcaaatgcacatatacctaatgataccataaaaatcaagatataaagcattcccattggcccctttggaataaatcttactccaacctttggcagctatttatctcctttctgtaactgtggagtagttataatttttctagaatttcacacaaatggaatcaaagagtaagtattcttgtgtttggcttatttcactcaatataatgttgattgatctagttgttgctagtgacagcagttcatttcttcatattgctgagtattattctacattctagatacactaaaatttttattcatgcaccagctgatggacagttaggtcacctctagtttttgctataataaataatgcctctataaatattcacaaacaagcttttgtgtggatatgtttctattttttgagtaaattattagaattggaattgcttcacatagggtacacagtatattaatgcactattttctttaaatctattgacattttcctggacatgagggttgtttctagtttttggctcttgtgaataaaattgctattaacatttatgtgggcatatgttttgattcactatggtaaatacctacaagtaaaattgctatcttgtatgataaatgtatgctaaatgttattggaccatggcaaactggttttccaaaatgcctgtgcaatttacattttcactcgtaatacatgaaagttctagttagtccacattctcaacagcacttggtgtgttctgtcttggtattgtgtgtcttattatttaaaactttattaattcttttgtctgtttagtggtatcttgttattttaatttgcatttccctaatgactaatgacaatgaaaatcttttcaagtacttatagattattcatatatcttcttttgtgaagtttattattcaaatcttttgcccatttataatttatttgtttttcttcatattacagaattttaagagttctttatagactcaacatacaggtcctgcatcaaatatatgatttgtgaatataacccctgactctggcctgtccttttattttctaaacataaatgtcttctgaaaagcagaaggttttaattccggtgaagtacaaattattgttttcgtatggtttaggttttctgtgtcttagttaagaaagctttgcctacttagtgttaaaaaatttttctcctatgtttcctcaaaagtttcatgatttcagcttttatgtttaggtctattatccacatcgagttaatatctgtgacttgcatgagaaaagaatcaagatttatttttggatatccagttgttctgacaccatttcttgaaagaaaatattttcccaattgagttacattggcatcttagtcaaacatcagcttatctatttttgagttctctattctgttccattgatctatgcatctatcctttcaccagtccacaataacttgattactgtagctttatggtaagtcttaaaattagatggtgtaagtcctccaactgtgttcttcttgttcaagattaacatattaaaaatcttttgaacatatatatatatgtgattaagcttgttagattttattaaaaaggttttgctagagttttaatttcccttttactttcttcatcgacccattggtttcaagagcacgttgtttaattttcatctatttgtaaagtttccaaaatttctcctgttatcagtttctagttttatactattgtggtcagaatagatatttggggccagacacagtggctcaggtctgtgatcccagtgatatgggaggccaaggtggaaggattgtttgaggccaggagtttgagaccatcctggtcaacatagtgagaccccatctgtacaaataattttaaaaattagccaggtgtgatggcacatacctgcagtcctcactactcgagaatatcacttgagcccaggaattcaaggctactttgagttataatcatgctaggtgacagagcaagaccctctttctaaaataaaaaagatacttaaaatgattttgatcttcttaagtttattaagacttgttttgtggcctaatatattatctttcctatagaatgttccatgtgcagttgagaagattgtatataatgtagctgtttgatggcatgttctataaatgtctgttaggtccatttaatctagagagcagtttaaagctgatgtttctttgttaattttctgtctgaatgatctgtctgttcctgtaagtggggtattgaagtcctctactcttattgtattggatagtcaatgtttctcttcagatctattaatacctgcttgatatatttaggtactccaatgttgggtgcatatgtgtttatgattgttgtattatcttgctgaattgacccctttatctttatataatctttgtttatttttacagtttttgacttgaagtctattttatctgagtatagctacttctgctctcttttggtttccatttgcatggaatatattttccattccttttctttcagtcttgagtgtccttaacagtgaaatgagcatataaaccagaatatagctggggtttttttttgtttgtttgtttgtttgttttatccattccagccattctgtgtcttgaatttacattcaaggtgattattagtaggtaaggaattattgctatcattttgttatttttttttctagttgttttgtagatcttttcttcctctcttactatctacctttgtggttaagtgaatttctttaatagtatattttgggtttttgcattttatttttattgtatctattataactttttgctttgtggctacactaagtgttacaaaaatatctcatgatataacaggttattttaagctggtaacaagtaagcttttatagtcataaaaaactacattttaatgacactctctacttcacattttaaatttttgacagcatcattcacatcttttgtattgcatatcccttaacaaattgttataattatccttattgtttttaatagttttgtttttaaccttcatactaaagatttgactgatttatacaccatcgttacagtattagagtattgtgaagctgactgtacttactttcaccagtgagttttatactttaaaatgcttcagtgttagtcattactgccctttgctttcagcctgaaaactgaagaactctctttagcatttcttttaagacagatttggcggtgatgaactccctcagcttctgtttgtctggcaaaatatttctctctcctttagttctgaaggatagctttgctggataaagtattcttgattggcaggcctttttcttccttcaacacttcatgtatatcatcccactctcctctggcttatacagtttctgctgaaaaatattgagacttgttttatggccgagattatggtttattttggttaatgctctgtgtaaatgtgaaaaatctgtcaatagttgttggatagtgttcacaattctatatcctttctgtctgtgtacttctatcagttgccgaatgagacatattaacatattcaactatatctattctccctccccttctgtcaatttttgcttcacatactttgaggctctattattagttgtattatatcttgttgattagttgacaatgttattatagggaatgtacctctttttaatgaaaattgttcttattttaaatctagtttgtcttatatcagtatagccagaccagcatttttttgtagtagttgcgtggcatatcttttggggccctcttatattcagccagttggagtctttacatttaagctgtgtttcttgcaaatggcctattgtcttgtctttcattttcatctactcaattttttttacattacatgcatggagtttttagattatttacattacaagcattgttgatgtgaatatgtttaagtgtaccatcttgttatctgttttctatttgtcccatgtgttctttcttcacctaaaccttttttttttctgctatattaggccattcttgcactgccataaataaatacctgaggctgggtaatttataaagaaaattgttttaattggctcacagttctgtaggctatacctgcatgccaccaacatctgctcagcttctggggaggcctcagggagcttttactcatggtaggaggcgaagcaagagcagacatgacacatggcaaaagcaggagcaagcgggggaaagatgccatacacttaaacaaccatatctcacaagaacacactcagcattgtgaggacagcaccaagccatgagggacctgcccccatgaccccaacacctcccacaaggccccactttcaacattggggattaaaatttaacatgagttttgttggggacatatattcaaactaaatcgccttcctttttgtaagatttttaaaagattccattacatttccattactgacctctgtttccaacattttattgtgaattttttcaaacttatagtaacatagaaataattttacagggaacacacgtataaccaccacctagtttctactattatgattttactataatcgttctatcacatacttatgcatccatctatctatccctccacccattaatcaatccatttttcagtgcattgtaaaatagattagagatgttagtacacttctcactaaatacttcagcaatcagatcatgaaaacttgatgcttgtttatgactttttatccattaatataaatttacatgaaatgcaatgctcaaattgtaagtgtacattctctgagttttaacaaataaatacatttatataacataaatccataacaaaatttagaatatcaccatctccccagaaagttcccatatgtctctttccagtcaatcaccatgatacccatctaatttgatttttttctattataaattagttttacttatttaagaactttacataacaggaatcctataatatcctcttttatgtaaggcttatttcacttagcataatatttttgaaattaatccaagtcgttgaatgtatgaacaattcattcctttatatttcttagtaatatgtcatttgtttgactatactacagcttttaaatgcattctccttttgtaagacacctgggttgttttcaatttttagctattatgaatataatttagctattatgagtggataaatgcttccagttttcttgggtcaatttctagaagctgaatttctgagtcactaggcaggtgtacgataatccttataagaaactgctaggtcttttgtccaagagaggtatacaattttgcttttcaaacagccatctatgacattttcagctcttccacatcattgccaatgtttggtagtgtttcaatctttttagtttggtcattctggtacgtatatagtggtatctcaccatggtttaaatttgttgaacacttgttgatgtgcctattggccagtcatactctcttctaaagtgagtgctgaaatattttgtttatcataaaattgggttacttgtcttatcttagttttaagatttctaaatatgtactggctatcagacctttccatatagttgtttttaaaatatattttccctgtaggtggcttgcatacttattgtctcttgttttcttttgataattagaaatttttaatgtagataaaatctaattcatgatttctctttttattgttattgttttctgtgatgtgcataagaaatatttgcataataccaaattacaaagtttttttgttttctcgtaaatgaattatggttttaacttttttatcttggctaattattcattttatttttattatatataaatatatgtgtgtgcatataaatatatatattccaatagctcttggggtacaagtgttttttggctacttgaatgaattatataatggtgaagtctgagattttagtgcacctatcacttgagtagtgtacattatataaaatatatagttttgtatctctcacccccctcccacccttccccattctgagactgtaaagtccattataccactctgtatgcctttgcatacccatagcttagctcccacttataagtgagaacatacagtattgggttttgcattctggagttactacacttagaataatggcttctagatccatccaagttgctgcaaaagacattatttaattttttgtatggctaagtagtattccacagtgtatatatgccacattttctttatccacccattggtcgatggacacttaggttggttccatatctttgcaattgtgaattgtgctgtaataaacatatgcatacagatatttcttgatataatgacttattttcctttgaattggtatctggtagtgggattgctggatcaaatggtagatttacttttagttctttaagaaatatccatacagttttccatagagattgtactaacttacattttcaccaggcgtgtataagcactccctttccaccacatccaaaccaacatctattgctttttgactttttaataatggacattctggctggggtaagataatattttatcatagtttcaatttgcattttcatgatgactagtgatgttgagcattttttcatctatttgttggccattttatatctgcttttgataaatgtcaattcatgtcttttgcccactttttgatgggattattatttttcttactggtttgtttgagttccttgtagattctggatattagtcctttgtcagatgcatagtttgcaaatattttctcccattctatgaattgtcagtttactctgattatttcttttgctgtgcagaagctttttagtttaattatgtctcatttatttatttttatttttgttgcatttgcttttggggtcttagttgtaaattctttacctaggccagtgtgcagaagaggttttcctaagttttcctctagaatttgtatcgtttcatgtcttagatttaagtctttgatctatcttgagttgattttttatatgctgagtattagggaaccaatttcattcttctacatgtgactatccaaatttcctattgtatttattgaattatttattgaacagggcctcctttccccaaattattttttgtatgctttgttaaagatcagttggttgtaagtgtttggctttatttctggattctctattctgttccattggtctatgtatctacttttataccagtaccatgctgttttggtaacaacagccttgtagcataatttgaagtcaggcaatgtgatacctctggatttgttctttttgcttaggattaccttgaatatttgggctcttttctggttccagacgaattttagaattgtttttcctaattctgtgaaaagttatgttagtattttgatgagaattgcattgaatctgtagattgctttaggcagtatggtcattttcattatactgattcttccaatccacaagcataggatatatttccattagtttgtgccatctatgatttttttcaacagtgttttgcagttctccttataaagatgttcacctccttcattaaacatatttctgggtattttttggcagctattgtaaaagggattgagtttttattttattttcagcttggttgttgttggtgtatggcagtgctacggatttatgcacgttgattttgtaacctgattctttactgagttcattttccaatctaggagtcttttaaaggagtctttagggttttctaagtatatgatcatatcatcgacaaacagagataatttaacttcctcttttccagtttggattccctttatttctttctcttgcctgattgctctggctaggacttccaatactatgttgaatatgagtggtaagagtgagcatccttgtcttgttctagttcctcggggaatgctttcaactttttcccattccatatgatgttggttggggggtttgtcatatatggcttttattattttgaggtacgttccttctatgcttagttttttgaggatttttatcataaagagatgctggattttatctaattttttgcatttattgaaatgatcatatggtttttgtttttagttctgttaatgtgatgtatcacatttattgacttatgtatattaagccattcctgcatccctggggtgaaacccacttgattgtggtgaataatcttttcgatgcgctgttggattcagtttgctagtatttttgtcaaggatttttgcatctatgttcatcagggatattgttctgtagtttttgttgttgttgttatatcctttcctacttttggtattaaggtgatactggcattatagaatgagttgggaaggaatccctctttctcaatcttttgaaatactttctgtagaattggtaccaattacttgaaagtttggtagaatttggctacaaatccatcaggccctgggctattttttttgttggcaatttttaaattattgatttaatctcactgctacttattgttctgttcaggatttctacttcttcctgtagtaatccattttaaattcagttttgtgtagagtgtgaaggaggtgactgaagttcatttttatctatatagctatccagttgtgttagcattatttgtcgaaaaaaattcttttcctgcactaaattgctttgagaatgatatagaataaaatcaaatgaccatgtagtatgggcttatttctgtactcttaattctgttccattagtttgtttgttaatctttatgccagtatcacacttttatgatcattatagccattttagtaattctataggtcaggtcatgtaactactccaaatttgtttttatcaagattcctatatacatgcaacagtttttgtcttttcatacgtattttagaatcagcttgtcatttctatacaaaaattatgatggaattttgactgggattgcactgagtttataaatcaatttgggtaaaattgatattttaacaatattgagtattctattccataaaatggtccatacctccaattatttagtcttcagaaatgttttgtcatttttcagaatagaggtcttatatatattattttgttaaactgattcctattttggttttgatgctacaataaatgaaattttcaatttttctttttgtgtattaattttatatttagtgatattgctaaattcacttgttatttagaggagatgccttttagattccttagtattttccacattaaaagttttgctgtctgcaaatacggacagttttacttcttcttttccaaatattttgacttttcttttaaaatttttttcaaatttcactggctataactgccactacaatattgtatgaaaatggtgagcatgggcatcttttctttttccttatcttacattgaaagcattcaatatttcaccataaatatgatgctagctgtaagattttcattgtgccttttgtcagatgtagtatgatcttatgaatacaagtttgctgagagtttttataaaagaagattgttgaattttgtcaaatactttctctgtctattgaaatgatcattgttactttttccttctaacacagtgaattatattgattacttttcaagtgtttaatcaatcttgcatttcaaggagaaaccatgcttgattattatgttatcatatatatatgtatatacatatatatgcatacacacatatacagatctgattaaattaacatttggtaagtatttcaaaatcaatattcatgaggaatattgttttgtaactctttgtaataccttttgttatattttggtactaaggttatgctggtttgataaaacaagtctggaattttccctcttcctctatgttctgatgcagtctgtgtaagataggtgtcatttctttcttaaatgattaattgtatttaccagtgaaacgatctggacttgaagattgtttgcatgaatgtatttgataattaatttgattactttattagatatagacctatgcagatttaatatactgtcttatgtcggttttggtaagttgtattctttaattaatttgtctatgtcttgtaagttttcaaattattgttgacataagtttgttcatgagttttattaacttgttatgtcttttagacataaaaaaggctaattggacatgtagtgataaactcattttcacccttgatattagtaaattgttttctttccctaagtaattgtctaagtagaaattaatcaattttattgatatgtttaaagaataaattttagtttggttcattttctcgactgtttttctttttgtgtcctttcttctgcttacttcgggtttactttattatttagtttctttataataaattaatagattgtattttgtcttttcatttttaatataagcataatgctataaatttctctgaagcactgctttatctacattactcaaatttcgatatcttgcatatcattatcattccgaattcaaaattcagaattcaaaataaattataattctttttgtgattttaaaatgccttttcatgttattcatatgatctatatgtttactaagttttttctccagttattctcacaattgttgagataggactgttaaaaccttcaaaaatgattgtaaatatgtctattttcttcttttaactttgttgatttctgctccatgtatttttaatctcttttattaaatgcatatgtatttatgatcgttatgtctttctcatacattggcccttttatcattatgaaacattacggtttatctctcatgatactctttttattgaagtttattttgctaatgtaatagcaatgccatccttcctttggtaactttgtgcaagatgtatctttatctctttacatttaaaattcatctcttatagatagtatatagtaggatattgcttatatacaagtctagcaatctctgccttttaattcaagcatcctctgattaacatttaatgtaattattgacatatttaatcgtttttgtttcagtgtctcttctattttttccccttatgttcctcctttcttgtattttttttggcttagttacttttctgctttcattttatccattgcccatttacgtacaactgtctttatgttactttttttacattcataaactttatttttaaatcagttttagattcatggaaaaattgacaggaaaatacagagatattccatctactccctgcctccacaaatgcatagcctctcccattatctacatcttctatcatagtggcacagttgttataattaatgaacctacattaacacattattgttactcaaagtccatagcttacattagcattcactcttggtgttgtacattctgtgagttttgacaaatgcataatgacatgtagccgccattttagtatcacaccaccatcatagtatcacacagagtattttcaccgccctaaaatcctctatgctccacttattcatttatccttccccctaattcttagcaaacactgatcattttactgtatacgtttttgccttttccagaatgtcatatagttggagtcatacagtatattgctttttcaaattggcttctttcacttaatttcatccatatcttttcatgacttggtagctcacatctttttagtgctaaataatagctcattatctggatgtaccagtttgtttatccattcacttactaaaggtcatcttagctgcatccgagttttagaaattatcaataaagctgctataaatatctatgtgcaggttttgtgtggacataagtcttctatttacttggataaatgctaggaacacaattgcttgattgtatggtaagcacatgtttatttttgtaagaaactgcttaactgtcttccgaagtggctgttccattttgcatttccatcagcaactaatgagagttcctattgctctacatccttgccagcattttgtattgccagtgttttagatcggccactctaaaaggtatagtggtatcacattatcattctgatttaaaacttcctaatgacatatgatgttgagcgtcttttcatatgcttacttgtcattcatatattttttggtaaagtgtctgtttgggtcttttgcccattttaaaaaattgggttgttcattttcatattgttgaattttatgaaatcttattatattttgaataacaatactttatcatatatatcttttgcaaatattgtcactcaatctgtgctttgtcttcttattctttcagcattgtctttcacagagcagaagtttttcattttcatgaagttcagcttatcaactaggtttttcatgtatcatgcctttggcgttgtgtctaaaatatcatctccatatctgaggtcatctaggttttcccctgttatcttctaggaattttatagttttgaattttactgtctgtgattaatcttgattgaattttgtgatggatgtaatttctgtgtcgagattcatttttttctccttgtagatgtccagttcttctaccaatatttattgaaaagactcttttctccattgtattgcctttgtttttctgtcaaaaatcagctgagtagagttatgtgggtctattattgaccctctgttcttttccgctgatccatttgtctactcttttatcatactatgctgccttgattactgtagatttatggtaagtcttgaagtcaggtagtgtcagtcctctgactttgttcatctccctgaatattgagttgactattctgtgttttttgcctctccatataaactttagaatcagtttttgtgagcaacaaaataagatgctgggatttttattgggattgcatcgaaattatagattaagttgtgaacaactgacatcttgacaatattgagttatgttatccatgaacataaaatctcctccatttatttagttcttctttgacatctttcatcagagttttgcagttttccttacatgctgtacgtattttgccagatttatatctaagtatttcatttttaggaagttctgtgttttttattcaaattctacttgttcattgctggtatataggaaaacaactgactttggcatattaactttgcatcctgcaacctcactgtaattacttattagcttcaggaggttttgttgttgttgattctttcagattttctacataggtaatcatatcatttatgaagaaataaatttttatttctttcttcccaatctatatatctttggtttcattttcttatcttattgcatttgataggacttccagtataatgttgaaatgctgtagtgagaggagacatccttgcctttttcttgatcttagtgggaaagcttctagtttctcaccatgaggtatgttagctgtaggtttcctgtagatgttctttattaagttgaggattgccccttctattccaggttttctgagagttctcatcataaatggatgctggattctgtcaaatactttttctgtatccattaatatgaccatatgatttttttcttctttagcctattgatgtagtggattacattaacttatttctattgttgaaacaaccttgcatacctgaagcaaatcccacttggctgtgatgtacaattcttttttatacattgctggattccatttattaatataaatatctgttgaggatttttgcatttatattaatgaaaggtattggtttgaagttttattttcttataatgcctttgtctggttttggtattagggtaatactggtctcatagaatgagttacggaatattccctctgcctttgtcttctgaaagagattgtaaagcataggtataatttctttcttaaatatctagtagaatccaccagtgagaactcatctgagcctggtgctttctgttttgtaaggttaggaatcattgattcaatttttcaatagatataggcctattcagattgttatttgtattactttttaatgttactctaagtgcttaatatacgcccctaatttttcgtggtttagttagagttagtgctctacacaaaatactgtcacacaaaatgtaaaaatcttgcaactgaattggtccattcacttcaccacccttcctgctatagttttcatacccacacgcacacacacgcacacatatatgtactacatgctatatatgttatatgatacatatatatgctatacatatgctatatgctacatatgtttgtgaaacaagaggggggaaattgatttttcaaattttcccatgtatttaacttttcttatgttattcttttgagtccggatttatctcaccccaatttaacaaatctgccttctcccagatttgttaaacattagagtcacctgaggaaggttttgtaaaagcaggtgcctagtgccaggacagtactgttcataggtgaggcttaagcatgggcctttgcaagatgctcccaacattacctgatgtacaaccagggccaagcaggcccaagcgcctcctgagctgccaaatagcatgacaaatatcctggggctggctcgctgttttatcctgttcccacctcatgtgttatcaagctattggccttatattatctgattatgagtgcctttcttatctctcctaaaatgtccttcttcaaacttcaaaatcttctcctaactcatgaatgttggcattagaagacaaatttggtcattctttcttatagcctctatcttgccatttgactcttcctatgatgtatctttaggttctccagcactgtctacccatcccaaaaaactctttcattcattctttacaaaaagtatgtgttacttctaaacttcacccttatggatatcacagtgacatgagaggcatgtagcaatgtaggaaacagtgtgctttcttgagtcaagtggtctcagttcaaaattcatcttgactcctgatgaaattcatgataatagacaagcaatttaactttctgtctctcagtttcctcacatgtaaaatagggataatagtaattccaacccataaagttttagagaaatttgatatgcattgtttagcacaatacgtgacactaagaaagttcaaatcaatcaataacagctggttattgccattattatgacagaaatggtctctgttctctacagagcttactaggccagtactaacctaagtgtggtccagagagtgctacttatccttgatgggacagggagcttgtaacagaatgtaaaccaaatcatcactaagcacgctgtttaatacagttgacgtttattttcttttttatttatttattttttggagtcttgctctgttgtcaggctgaagtgcagtggcacaatctcagctcacggcaacctccgcctcccaggttcaagcaattctcctgcctcagcctcccgagtagctggaactacaggcacatgccaccacgcccagctaagttttgtatttttagtagagatggggttttatcatgttggccaggatggtctcgatgccttgacctcatgatccacctgcctcggcctcccaaagtgctgggattacaggtgtgagccactgcaccctgcccagctgacgtttattttctagcaagactttctcaatgaaggagttagagcattgatttacattctacagcaagtgtctcattttgtaaccaacctgtactttaaggagcacttatcctgaggatttgtagcctccctggtgtagctaggtagtggaaattgttctgggcttgaaggcagaaaccctgatgccagctttagctctatcactggcaggcaaggtgaccgtggacaggccatttaaaccctgaacctctaattattcatctgtaagatggaaataattacctctctctccttccttcttgccaccatgagtttcacgtgcacttgagggctgcaacaatgccaggaaatgcttccaggcctctactgggagagtaagccaaatcagcccctggggtcatttaaagtcaatagctctccagagcttcagacagagctccgcggcagagtaaagaagaatgaggcttgctactagcttcctgcataccaaaacccagacgttgtgactcccactctcaggttaaatagaggtaaccaaaggcaaccaaagccatcattcattctctttcaaataatgttttgtgttcaagctaagtgccttccacttaaagggtactttgcaatttggggcctggcaatggcattggccacccattacttaaaatcttcccaaatgtacaaacattattagtacaagcatggaacagacaaaataacataatgcagctggtggataatggggaggacattgaggctcaaagcatcaagtggatcctcataggcaataagccaatccaagaaaacattgggcccataccgccgccagagcactaaggtagctcttcttggaatcggtaatagtgcagcactaatggctgcaaaaaggaccatattttctccccattcattaagccccagaaaaaggactgcatggacctctttactgctttaacacactcattagataaaatgtaccagttaacctcctcagaggaagaccataatctgagcacatgaattctgtcctccccaccctcctccgctccggaagtcctctacctggcaacaactgtcaattctttgctaggtagctgcttggacccacctgacaacatcgctgtttatactctcaggttctctgctgtccgcttgctaagggattcagctagctgagagagagagagagagagagagagagagcgagagagagagaccactagaccacggttatcaatatttgccctaatgtaatgtcttcagtgactatccaaaggcaagctctaataattatagctcccatagtgtaagtgcctctctgggacaaggcagtttatgaccagggtctcaggggcctccctcagctcttgctttggagcctaagtgtcactgccagtatgatggcaactctgttagcaatatcatgacccccagaactcctatcctctattgtcatcctagaaactgcctccctgattgtgtgtcaaatgaatttctgtccatcttgagctcccatcgcacctgcagttgagtaaggagtgcagtggaggttggcaagggcaggtagctgggagaaagcaccgtcagtatggaactgagtttggttttgatttgggaagataggctgtttgtataaacccctacaatccctgtgtcgcccccatcatggcatttagttggctgtataaattgcttttcccataagaccataagtttctggataataaggactctctttctcctctttgtgacttcagcatcacataataagcattcaataagtgtgtgtgaacaagttcatggccagctggccagctactgctcatgcatttccttgcagcttcagatcactggttcagcagagttggttttgggaaagcagtctgaggtgtcatcacagagcaaacaccatggatgagtgacacggggatagtctttgcccaacgtgtatatatcaagggcccacttgacagacattccctcagaccacaacagcctgcccaaggccaactggagaaagccctacacaaataaaactatcccttctaccggcaacctgaccggtcatgttcctgtgtatggcagctatgcatctgggtcagctgactccacccctggcgcttgtattaagaagccctagtgtgagtgggcaggcccttgggtggataatttagatgtttgagcactcaggtctcagctacggagtccaggggataaggggactcctagagatggaatggctaagggccacacaagccttccttgacaagctgaactgactgctcttttccatttcctgtgctccaagaagaggttttcagccaggtttgggggcagaaagaagctatgaaataagacttatgtcagggagtagtatggctaagggatagcataacaaatatttcgttttcaactcgataggtgcctctacagtcatattcctaaatcagtgataggaagaaatgctggtgtctttacttttctctgttctacaaaagcttttgatagagttgggggttacagaataatgcataaggaaaaattgaggcacaatcaatgacagtctgcaattaagtgctaaattgtctggcacaggccttaagtgctgcaggaatccaggggaagggcagtcaatgaaggctgagtaatttgtgggtgggtggagcactgatgtctgagaatctataatatgactccagtcagcacagatttcctggaggaggtgggattggcactggaccttaaaagatgagaagaactgggcttgaaggagggaatggctctggttcagggcacaaggaatggtagagcaaaggtaaggaggcagatggagattagatccaagtgcagaggtctggctctgacaggggtggggtggtctgtacagggaatcagagtgatcacatgactggctgccggggcaaggatgatgtggaactctgactcagtgcctctgggtaagtggactaggttgcagctgtgcgccaggtgaatctagaactcaacaaataaattcccttgcaaaagtgaatttcctgggcagtctgcaacagggttcctcccttccaggagctctcatccctgtacaggcaaagtctcattcaatgcccacaacaaccctgggaggaaaggaggaattgctaaggattcataaactccaaatacacatggtctcagcggagacagcagagtgggttggaaggtcacctgtctcctggatttcaaggcaagcactctgggaggcagcagaggtagcagatatcaaactgtgcttccaggaatctggaagtacgttcaactcagaattcctcacattgttcactccctgcaaatgcacctggttaacaatgacaataatactgtcattgattgagtgcctacactgtgctgggtactttaaaggaaataattcatttcatcctcacaataatcttttgaagtgtggagttactgtctttatcctacagatgaaggaactgaggcaaagagaggttaaataacttgtccaaggtcacatgactggtaaatggcagtcaggattccaaaccgcgtagcctctacttcaactctctcgcctgcctcattccacaagcacctgccctctgggtagatctgcgatggatcccctataggaaacatcttattcactgcctattaagagactcaagactccaaagagatgtggtctgaccagagacagtggagtgggtaagaatgtcctggctcagagccagcgtgtttctattttcccacttgctattattactgctgccttagctcaatcagcagcagcagcaaaaacaacctagcacttccttggaaccccaatcctgctttctccatttgaacaccctgagagtcctatgggaagaggcagggcacgtgctgtgggcctggaaggaaggaggaggcgacacaataatgttgccagaggccagggaaggaggcaaggggaggagagtattaatgaacccagggaatcatgaccaagggcagaggaggatgaggtcccacaggcagagaaggggagaggtcatgaggtgcaagccttttagcagagcccagactgaggggcagagagtgagggcaaacaagcttcggtgagatcgaaatgacacctcaaagcagcccttgtgggaacagtgagctgccttgattgttgacaatgaatggtgacttccagactgtcatccgacatagagacacggtaggcacctgaagcagggtccactgcagcaggctctaagccctgtgcttcacgggccgctgtattcttacccttttgctgtgccacagacccttagctgaaagatgaagcccacagattccttctgacaataatacttgaaatgcataaaaatacacaaggttataaaggaaacaaattatatccaaatatcaaacaaaacttgtatgagatgctaatataaattttttgtattaatgcatgaaatcaaatctagtggtgactgtaactactactataatttcaaactactgtccactataagggctgtctggagatagctacaataataatgtgatatgaaaatccctctgatttctctcagtggcaaagcctcacgtactactaatgctactgtggttcattgcctacattcaaaattgaatgaaattagaaatttcaattagaagttgatgaaaatagaaattcatttttttcctcccaagatcacaggggtcctgtttgatgggcaatgggaattcattggtcttgggacaagatgattagagagctagtcccaggtttcctactcatcatgtgtcttgaaagtgttatctgactcttgatggccagctcacaaaataactctgttcttccttctctcgagcattcatgagaaggtgggcctgctgagttatctgccccggttctggagaccaggtagggggaagttcaatcccaagtccaggtccaaatccaacaatcttccagctcctatacaggtcctcatgctcacaggaccatccttggatatggaagggggttgctcctatctttgtcaactggttccagaggccacgactgaaaaggaattcagacaaaggtcacaattctgccttgttggagtaagccagccccaccctagtggagccctgtgaagcaagcacacacatctggttggatatagcatggaatgttcattacaaaatcagttatgcttttacagtaagccccagggagtttggcagacaaagcaaatgacataaaatgagatcgagcgtgagagtgagcgagccagggagagcaagcggaaaagagagagagagagagagagagagagaatgaatcttagagaattaaatttgaaagaggccttagaggccctgtagcccagctcctttgtctctgttggagatgccaaggcccagagaagggacatgccctagtgggacccctgagtagctcagtgctgagtcactggctaatttcttgctctttgcccttggcaactcatgtctatttgaccagagatgaaccaattggcttggaagatgcttctggaagcactattcaaattagccaacagctcctccatgctgctgtatttgtcataacaaacacaagaataaataatgcagccttgaggaggggcagccagaaatgtctgtacggatgccagaagcagccagggatcccctttggggcatgctggggccctcaggagggtcccaggtgctggatttggctatgaccacagggcataaagtgtgagtgcagctgaggcttttctgcgtgtataatttccttctctgatttcccaaggagttaatgaaaagattataatcatcatcattttcagcagcaccattgttttgcactttcattacttaggtgggttttagccctacataggttgatggccctcagtccttacttgcacccaggaccaaatggaccactgggccagtgcaggactctgaactccagctcagatttcaggcccagctcttcctctttccaggtgaatgggatgacttgagtgaattcccaaccttcctgaatctcagtccccaacttgcagaatagagaacttaacctctagcttgtgatctgatgggacaacaggttctgattgctgctcaccattctccctctttgtgtggggattacacagatagctcctattgaaaagcctgctccctgggggtcataccgttttcttgtttgcaagaaggagcacttgacagaggcaccagcacactcaaaagcgaaatctgagaagaatgtaattttctactttttcttcttgcacaaaagggaaaatgatttactgcatcgctccccagagcttgatgtcagctggctgtagccactgctacattagggagtgacaaatctgaagcttgccatcagagtttatgaacaatttatgagggcaaaatatgcatcaagctctgatctttcaggctagggaggtaaggcaggggaaaggccagaggtcacctagccagcctcctgcctctgaccacacacatttcagctttacactaaggtcaaatgaccagcagctataaacatgatgcaggaagaatgtcttgctgggcactgcaattcataaacctacctccatccagaggtagaggttggaaaagaaagagcacaggccctggaatcagacagacctaagttcccctcccagtgctgccacttaagatctacgcaactttgcatcattctctttccttctgtgaacagaagtttctccagtgaccttcaagttggtctgtagccttgacctttatcttatttcctgtcctccaggtatctactagagactcctgtgtgccccacctctgaactctgaatcttttcctgagtcctgctcctcttcctttgcatgcacatccatcaacctacctacattcattgtcatagactctgccttcccccgtcactctggatgaactgtcccttctctgatcttagagcagccgctccaattgtgcccttgatcctatgcttttttacctactcaaggacatcactatagtggttttctcctctatctgcatcatgccactttccctctctactagatcatctccatccacatgcaaacatggcttctatctaccatcttcaaaagatccaaaccttgatcctgtctcctccagctaccaattttcttaaccccaaagtgagccaaacacctacaaagagttgtgttcctttctggctcctcttctgtatttcaagttgtttccctattcttgtcagcttctgatccactatttcactgaaatggttcttaactaggcataaatgggttcaatcggcaaaagcccacatcttcctgaagcttatgatcacttctgtcctcatcactctagaccttccagcagcatttgacatggtaatcactcctttattcttaaaatattctcttctctgggcaagacctagaattactctcacccagttttcaaccgatttgtagcttcttctcttttactggagcttcttcttcttcttgatgtctgtccgaatgtcaaagtgccctagggctccatccttgaccttctccatgtcatctatactccctccctaggagatcacttgatttgcaatattgtttgggcaatgataacttccagatttatctctccatcatgatctctcccctaaatattggactcatgtatcaaaatacctacttgtcatctccacgtgtgtgatagatatctcagacttcacatataacaaacacaattcttgattagccaccttctgccatcactaagtttgctcctccctcagtttctccccaaagggcaccaccatttactcatttgctttggcttccctcaaaattatgagtcaaacttgattcctctctttcgatcaatcacttccaatagcctacaaattgacaaatgctgtgagcaatatcttcaatatgtagcattcaaccactacccaccacctctactgccaccactgcgttccaagccaccactatctccacccctgattattgcaatatagtctcatctagtccaatctgactactggctccactactcactccactgaacttgaacattaccagtgacctccacattactaaatccgttggtcacttctctgtcatcttgcttgaccttttaggaacattgggaagaggaatccacaagcttgtctggtttcttttatatctctctgtgtatttattatcagcctcctcagttggcccctccttctctactgtacttcaacctctatctctggttaaaacatcagctctgagcttcagacctatataaccaattgtctactagctattttctcttaaatgtaccagaaaatgcctcaatgtccaaaactgaactctcgatcttcttcccagggctttttgacccccagtggcccccgtccactatgctccctaagcaacaaacctgagaatcacctttgacacctctctctcctttaccacacctatccaatcagtccctaagagtaggacattctacctctccccagtctcttagctttaatcccttctcaccatctgttttagtggcactttttaagtccaggttataatcatctctcacctggacttctgcaactgcctcctctctggtgtcctcacttctacttttgccactctcctgtcctctcagcatgctgcaggaaaagggatcttctgaaaacatggagcttggccgtagctctcctgtgctttactcccccaggggcttcttcctcagtgttcccaggatcaagttaaagctcctgagactggcattcaaggcactgcaggacctgaccctaggcaacctcagcctgtcttcctcccaccactccttgtatctgaggtcccagcctcaccagagcactcatgcagtcataaccggatatctgttcccaggactaggggatcctcaaacgcaggaatcttgtcggagttgctttgtcatctctgccccccatgtgtgtgtccctatgtacaggagacgcacgtgtacaggaggcacacacagtcagtttcatgttttcctccatctgtctccacagtccctgtctatgtataatccttccctgcttgcagttttcccacccttaaaaatattagaattttgttgtcaaatctcaccaatgagttctatgtgtattatattgtttctgatatttttgtgttttgttgtgttttattttgtttttgttttatgttattcctatagtgtcatggctgccagcccctggaggcctaatcgaaattcgacgggagcctgtcaccactcagccacatagcagaacaacagccacagccactgcatcagcacagcactcaacagtgtaaaagacttttctcccattttcccaccacaggccccttccatcactcactgatggagggaaggcaaggactccattattcctgcttagcagatgaggaaactgaagcactgcaaaggttggaagggtcactaatgcctctcagaaaaattctccttgctgaacaggaggtcagggtagcctccagcaacgcactgggctagggtgagacaagcaaggcactgagggtgtaaaatttaaggatacatttactttcagggtcatgcaagttcaagattgctgccagacagtaagcgcctgcaggtggagaggcagaccccagagtggccccatgggaacatagctattactagagtcctaagcaggaggaagaaccctagcccagggctccaaagacggcttcctgactgacttactgggtacctttgggtcaatacctcctcccctcagggccttggggtccccaaaaatacacagggatttcacattctctgtcttgtgaggtagttttgtttccaagctctccctgtgactctggttcccggtacagcccctaagcccagaagacagccagtgctaaggagctgctactatcagccccttagaaatccactctgcatgagtctgagcaagctgttgtgcataggtttgatttaaggccatttcaataagccccaattcatcatcctgaaggcctttgaagaaaagacaactgccattttctaaatgccattatgcaatcaagccttttgcaggcagcccggcaggtccacatgcccgtacgcgtacccagactagtacatctcacgtcttgctgagtgtgcctgggctcccttaaccatagagccccaatggtatgggggctggcgaggatgatgcaggaaagagaccggaagcccgaacagtgacacggaccacagaacaggcgttctgtgaaaagttgtagaaaatcccatagcaaggaggccctacctgacccaggatctttctcgtctgtcaggagcttgagcctgttccctgagctccctttccctgcagggcagagacccaaggcagccttctaagaggaccattgtccctggaatgcagtgctaagagcagtgacttagcagccaggtttgagtcttggcttcagtacctcttagctctctgaccctgggaaagtgagcaacagctctgcgcctcagttttctcatctttaaactgaaggtaataacagcatatcaacttcctagaattttgtgaaaatcaaatgctgtgctatctataaaactctgagaatgaggcttaacgtgtagtaagctttatatcagtattatgattcttgtcattttcacagcaccacaaacaggagtggcaactgtgggagctggaaagtaagctagggattcccctagaccatggggtatgggagaagcagagcaaggtatggaaaatgaaggcctgattttaaatcctgccttcacttttctatagccatgggttttggggcaagactgggtactggaccgaacctccttctccatctctaaaaggggtagagactccccagctcagggggttctttgcagaagttgatgaagaaacatatgggacactgctttataccaggcaacacaaaaaactacccagcagggtacatgtgagaacaaggtctcttgtttcccaggctgtgctcttggtaggacactagcttctgcagtgctcacaggtatctccctaagaaatagcctctcttccagccataggctttgcactcagaaatgctccatttgcacattttaaggagcaatcatcagagtctcatgttcagcctgagctctttgatatatctggccaaaagaaaggttcttaggcccttgcagttgtctcacagtggggaccagccacagtaaacctgggccacagtggccagcctgtgcatttgttagctgatgcctgtggcgcgctcaaaggatgggaaatggcccaagttaggagccccacattaagccttgggtgcctttgtctacccagaagctatcactctcgggtgctgaccttgtgttggcatggaagcatgggaaatggtcgaagttcagagccccacttttagcctgtaactcttgcaagtggctgttttcctggtgatctcttgccctacgacttctgctcttcctcaactgccctaacccaaacctcttccttccccacatgatgagggaaaggagagtgtgggagggggatccccagcttctcagtagcctggaacctccttggggaagcacaggaaccctcactcctgcaagcaatagctctattttacctggtagtccagcagggcacagctctacttcctgagccctcataaagaactgccctctgtcacatcacattgccaggtcacgatttatttccccctaggccagctgcagtagcctcagtgatgcgtgggcacttttccccctccacatctccccactctccagcccagccatgtcagcacgaagctctccatcagagggtgattagatttggataggggtttttttttccggacataattgtttcttaattcttttaatttcgctacctttaaagattacaagcaacaactagcacttgataaaaagaacattagtaattaatcgagttttcaagtagcgctgcttttgtggcaatttttcaaaatatatatgtaatttaaaatctgcaatttaaaatctgaggaggcagagacccttccaaatgatgcatgagacccctaccaagggatcaagcaatgcaaaaacctaagtaaggcccccaaataccaaggagaaataatctgttcatttattcatttgcttattcacacaatcacacatttgcttggtcattaaattagttaacttactctgtcacacattcattcactccttcatttatttgttctcatccttcttatatgctcactcactggttcacacactgacagaatctctccctccctccctccctccttccctcactctataacacccatagccccatggtgacgtagggctttagctgattttatagattttctccaaaagtaccttcagtgttcaaaaaaaatgatgaactttcatacaattagccaacttgaaccacactccttttattcaatacacactgcttgagagttcaatatgtgcagaggtagcaagagacagatgacattgaccacaccctcacctggcttgtggtcaacttggggagataagcgttttcacaaatgcttatattagatacaagaatccaaaagaggaaatacataattctgacagaaaggctgcatgcaggcatccattcagtgaattttcctgagcatttactatgcatcagggcctgggaatacagagagaactaagacatgatcttgcctttctggagctcaaaatccaaaggtggaaagagacacaggaccaaacaattgctataaaatatgggaggcattgggttgctgggagacagtgcaaagatcaactagtgatgagctctgttcagtgaaaacttatgaaacagtcaaccctggtctgaggtcttgaaggaggagtaggattttgtttgacaaatgtagataaaaggagaatgcttcaagtatgatccgtgggtagaaaacacaaggtatatttgaagaatagtagagtcctaattttctaaagcagaggatatgtttgagggagttggtggaaataagagttagcccttgagcaaggttttgaacgtccattgggattttgttgtgtgggtaagaggaggagacatggatggtttttgagcagatttgtgttatgatgacagctgggctcaagagatgaacttggaagttagatcggagagatcatagagccttggggcaatcagatcattgaagaagccagaggtactgatggaccaaagttggagagtagggagagaaaagccgaggcaaacctgaatgtgagtgctgcagggaggctgaatcaacaaaacagacttaatgggaaagatgagagtgagctagtcagagatactcaagaggattttagaatgggataccaagagtatagtggtgccattatgagagagaaagagagagagagagagagagagagaagcaggaaagaacaaggggaaaagggtgatgggtttggtggtagatatgttaaggagcctgaggaacagtcaaatgaaagtgttcagcatgcaattggacaataggcctagagcacaagaaggaagcctaaattattagagatagatatttgtgtcacattgattagcctcttgaccagaaattattaacattgggtacataagtgaacttctgggagcctataagatatatcctaatggtagaattgacacctgttggtagtgggttagatgttggtggaagaggaatcttccaagtgtctgtgaggaaatctggctggttaataatgtcatttacaaagttaggggataatagagtaggacagggcaggggacttgtgtagaaaagaacatgagataagggttagatatgatgaattcaagaagcttgtaggctgtccaactgaagatgtctactaggcattggttacatgtatctggaggcttgaaataaggtctgggctgaaaattgatttgggatggttaaggccaaaggaatagattagatcatgcaggaagagtgtggaaagtgagaaggggagacaactttggaactgattaagagtcaaaaatgaattccaaatgtctggcttcagtatatagactaatgatggtgtttgttcctgaaatgaagaacactttgaagtatttgagagaagtgtgaacatgagaagttccatttgacccagataggattataggtggttgtgggatatgcaagtggagattctcgagtatctctatatctgactctggagcttaggaaggagaattggattgagacagattcttgattttactgcagagataatggctgaagctgggatataggtgtggtctctaagagaaagcaagaagctgtccaagaaggatatgtgaacaagcagcttgctgcacaatgggagctaaggaataagagcggctctaggaaaaactagaacatgaggctgaacaaattctgcagaatgaagcttggcatgttgacaatgagggagtcatgagcaaccctgggggaagtggggatgagagcagattctaaggccttaaaaagttgcaagagggaataggaggcatcacatatagacctactcttgcaaaatttcaatctcgtggagagaggcaaccttcacaaaaagtggagttttctttacaagataagggagataaaaatggttacagggttaggagaaagagcaggagaaaggaagagagagaaaattctggagagaagggacaactgataaggagagtctgggtgggacacaggagtatcaacatcagaggccaataaaaagcaaatgctttggcaaatatgcaattgcagggaggagaatctcagacaaattaccaaaaagcatggtggatcagtctgagaatttacttgatttactccccatacactcaccaacaattacacataatcattcttagatcctagacattattgttatcattagttctaaacattgctctgggtggttggatcaaaggtgacaaatttccaggccacatggaaacaggacatttgcacatctccatttctagggaggagcagggtagagctctgtagtattagttgcctccttcttgccctgtagcccctcccatactgccttccacctattccttctccaagcacctttgccccagggctgcctagcagcagctaactcagaggaactcagagggaaccagaagcacaggatcaaatgtgtagctcttgtggaggaagtgagagaaatgtttgattccactaggctaagaagagagacggtgacagaccaagtagattcagagggaaagggcagaggagagggcacacaacaggtctgctcagcagcaggcaggtggctggccgtgctaagagaacatgcgtatgtatgacatgaatggaggttgtccccctccccaaattcccagcatcccacaacttttctcagtcccagaggcgtggattcctgactgactacagtccctgtggtgactctctcgcctgagttcgctgctaagaggctggtgctgatatttggaggcactccttcctctctcccaccgccacctctacatagagcccaggacatcatagaggcaagtggtatagtgtgtgaaagaattggctttgaaccactaaaccgttccatgcctcagtttctttgtctgcaaaatgggactaatgatgtttaccctgaagaggcataaggattaaaagagataatccacgcaaagcaactctctttgttaattaatctttctccagaggtcactaaaatctcatcagaggaaataagaccacagtatttgattcacttcagcttggaaacaagcagatcttaacatctcattaggtattcccaatacagttttatcccccaaccaacacagatgatgttgtctgacttacaaggaaaaatatgtgattcacagtgactgccaatttctcttctgctccatgggggattcagcatttttgttctgttgtgtaggaggaaatccagcctgattgtcacttacccaatgtctcccatggtggcactctgtgggttgccttgttgggcacaaactccaaatcaggaatggctacataatttgcggaacccagtacaaaatgaaaacgcagggccccttcttcaaattattaagaatctcaagatagcaatagtagagcattaaacccagcatgggactcttctgagcacagggctttgtggaactacactaatcacacacctgtgatgtgggccctgccctgaatccatacccaatgctctgatcttggtgaaggagagcccacaacagagtcataggttcatctgaaaaaaaaaaaaaaaaaaattccactggaagagataccactaggcaaagagctcactcctgattctttttcccaagaaccagtcaggtagatgccaggtagttatccacagataaatccttcaaggtcagaattctggaaaggcatctctgttggacaactctgttccctctcactataatcaaccagcaactgactttcttccttctgttactttttctaactgctccaggtgatttccactctcccaacccctgcgctccacacatcaacccccagcacaagggtactctaggacagggaccaagaagcctactgagccttggggatctgcaccctcttttctagccataccctgcatcctgacagtaaccatctccttagtgggtgataatctctcaggtaagtctgggaggagggaggcttccctgctgtatttctgagagcatgtgaggagagcaacagggatagaaagctgaaagaaggtacaaacctagaacagtgctacttaggaggtccatggatctgtgccagtctgcaaggaagtaagaacaaaagtgcagagtggttctaaacttttatagcaagttgataatgcctattaaatttaataacaaaaaataatttaaaaataattatgtctttattctcattattccagtaattctgttttattgtgttttaccagagtatttgtccatgctctttggaaatctaacaagctaataaaaaaagtaaacaaaacaaaaagtaggtgcttcacagtagataggtggcaaccatggttgccagccttgccatgcccccctgcccccgcctttggtgtagtgggcaaagcgctgaggcagaagtcaaaggatcagcgtgcttggcctggctcttttatttccttggacaagttgtttatctgcgagctccctttttctcatctgtaaatggttcatgaggaccccataaggtcttaaatgagaaggtgttttacaaatagtaaggtgcggtatttagtccagccacctcatacccctgccacgaaagcagtactggatcctagcacaatggttaaaagcacagcctttgaagtcgagctgtctggatttggatcctcccttcacaattcaccagatgggttacttcaagcaagctgtttaacctctcagaaccttcattttcttacctataaagaaggaatcatcttaatacccacctgatagggttgtgatgaggattacctgggtagcacttagaacagcatgcagaacacggtacacaaaaaatggtagccagtagcatgatttgattacaccctattcttgtcactacatgtgatcattgtcagctttacccgtgttcattgttctctcctttcactgctacatgtctccatcatttttctctttcatacttcatttatcgagtcccagattggtgcctttgtattttctactaataattggttattgctggtgtagaacatactattgatattagaatattgaccttctatctagcaaatgtgctcaattctcattagttctaacaggttgtctaattctcttggctttccatgtaaacaataacataattttcaaatatgcccattttgtttcttccttaacaatctatatacctcttatttctttctaggacttaccatactaatttgggatgtgatggcagcatcctcatcttgtttcctatgttaaagggaacgcttctaaagcttctcctctactaggtatgatatctgctgtttttaatgggtattattgatacaggtgaaggagatccctttataaagaattttacatttttatcacgaatagtgttaaactttattaaatgtgctttatgcatctatacaaatatttttcatttttttctctgagtgcatttatataatagatgccattgacagatttcctgatgcttaactattcttgcatcctggggataaactctacttggtcgtgacgtaatttttttgttgctgttttgttttaatgcatctttagatttagttaatgttttctttagatgtagttaatattttgtttattataggtgacctgtaaatcttttcttatgttattcctctccacttttggtatcaatattacagtagctctgttactcaactggacacattcccactttttctgattgctggaataacttatagaggaaaaagattatcttttcatgaaaaatttgatatgactattgacctgtaagactttctggaacaagatcttatgcaggaaagtgagctttcaacctccactacaatcttacatagtcattggcctattccattttcttagagcccagtttagcataaaaaaaaaatcaagacatctgcttactctctggctttcagccttttgttttagcatcagctttctcataacaccatccctaaagaacgaggaaccaggcttgcagttttgcttctgagtctgccattctttagacaagtgaagaaacggagagcaggaaagtcttcctcatctcttaaaagagttggactagtggatctttaatggtactgtagataaaaaggatattgtccactcttgtctcttaagaacagcagttaactcagctcagatacaaatgaaaaagatataaagaaagagaagaggaagggagagaataacagttgccagatggttcctgcctgcctagtctagtactttttgtaccctgggtgatccagtcttccatttggaagaactcttgtagatgcattttcacataaaatctcttactggtattttgccaggaaaatcttggcccagttggcgtttggtttgtcctgtcttgaaagaatgtctcccaccaccttcctgggggctgtcttggactttcagtttcctgcctgagaaatggactcttccctgctgatgatgattaacagtttgagttgcaactccttctggacataccaagtatctgtgcccagggcttagccttggccaggccaccagagaaaaaaaaatacaacaacaataaaaggagggatgtattatttcccttctttgcttatcaggaagccagtgacttttagtatcatgagaagtgatctttgtttcatttaatgggacttgaagtagcccgcaagagaaattgttgacatgattctaataacagtggggacatgtggtgggaaaaattctaaagatagtcccccaagatacctgttccctggctattcaatcatacattgatctatatactggcataaagacattttttcagatgtaaattttcaagtcagttgactttaagatacggagattatctgagctggtgttttctctggctggtagcggaagagaatgtcaaagagattcatagcaagaggaggatttgatgcactcttgctggctttggagatgaaggggctcatgtgcaagaaccaaagagtgacttctagaagctgagagcagccctcaactgacacccagccaggaaactgtgacctcagtcctaaaactgcaaggaactacactgcaccaacaacctgaatgtacttggcagtagattctcccctagaaactcagatgacaactcagctcagcacatatcttgatttgcgagacctcaagaagaggactcagttaagccacacccagattactgacacatgggaactatgagagaataaatgggtgtcatttacagccgctaaatttgtttcactacagtagaaaactaatgcaggacatctaattggcactcccaaagtgtacttccaaagcctacatctcagccctctgcatgcatgaaaccaaggtgggcacacgaagttcctgctcccctctccagccctgagcagtgtcaccgacttttgctaatgggctgaggcttccgtgtgatcttctggttgctgagctactggaaagagacccacttgacttgcccaaagctggaacttctttcaggctaataggaacaatccctgctattttcagagagctgtgcacaaaatgcttccattgtcattgtttcacagaggtctcacagagaccaccccagctgagcgggtttctctcttgatagaaacaattatatactcatttcctagatgaaaacaaaatgaggcccaaagagggcagatggttggctcaaggtcacagagcaagcatgttaaaaaactcctgctataaaacataacttacattgggtgactattggtgaattcctcagctggtgatttgcaaggcactgaccttttgcagctctaagcagtctactgacaaaacctggtcatccaggctctttctcctcatgtttgtctgcacttaatgagtggagatgcgaggatgcctatgagccgagatgtatctgtttaacttctacagtcacagtgagccccatattgcccccttggcttgcaaggctcttcgcccagcttgccacatggctgtctctctcacttccttcagagctttgctcagtggggccttctataaccatcctgtctaaaattgtaatgcccctccaaccctacctcatgctttatttttttctctattgcaagtacatctgatattccacatgtttttatttctttgtcatctatcttcatgagaacagggatttttgtgtgttttgttgactgctttatcaccgttactgaatacattgtcatataatagataataaaattattcttattcttattactactattattattatcattatcatatcagagctgggatggaaatccaggtatgcatatagtcaacccctccctcttctctaatcacatggccaccttgactctgtagaaacagaggctgtgtcaaggaccagccatcatatttcccactcactggggataaggtagagggaggctgctcctgccccagacctgtcattcccggaaccacgactgactgcagtgccaccttctctccctttttttatgcaaagtaatttctcaaaatgatggctcaggccccaagagaaaagatcttatctgcctaataacctgggattcattcggaccaaagggagcagaagcaacagattaatcctaatgcctggaatttattaaaaatttcaactgttcctaatgtgaaagatgaaattgcaccgcctgaagtgactgagacatatcaggtctgggcgatctccctgtggccaaagccacaatagctaactaatatcccttcctattagcagagcttttaggactatgagactgaacaaaaacggacaggtcagatctttccagcagggtgaaagagaagcagaggctgctctgtccactggctctgccacttgaactgcccagaccctgcccagaccctgcccagaaaccagagttgaggaacctatctagggcatatgaggcctttgactgcagcttctgaggcagagtctgcaatgagagatgtctgcagaacgctaagactaggcagaggtatcaaatagcatgcgcagtgcatacttctggaaagatgggaggttgctgtgcaaacgtacatagtattcaaacagctgacatcttaagggtgtctccttttctttagacatgtcacaatgtccaaatatcagatacacccctctcctgcccagtagccttgcctaatgtcatgtgccctgctaggacacaacctcactctggcctgcttcttgctcttcaaccccatcatcacacatgtgtatgtgtgcatgcacactcactcatacacacacccacactgctgctctactttccatccttggtctcagtcctttcccttcctcacctggtcccacttcctcccttgggtaccttttacttacctctaaaggtaaagggacatgttattttttaccttagaaaatggaagtccaagctgcatggggatctagtaggttgttctggcccctcagtaggaaaccatgcttgcataatgcttccttttaagaggagagaactagggcagtcctttacttcagagtaagttagggtcagccaaaattagaacccagacacaaagtaattggttgtcacattatctgtaatagcaaaaaattggacacgatctagatgttaggcaatatgaacagggttaagaaaattgttgcacattatctccaaggaatattatgcagccattaaaaatgattattatgaagacaatgttgtgacatagaaaaggcttataaattcgatggtaagtgaaaaggccaattgtaagactgtaaatatactgtaatcacagcaatctaaaaataaatgcacacctgtggccaaggccttggaggcaatgtgggatagaaaatgagctcttatggactaggatgcagggattatgggtgattttttgtttgtaaacatcctgtaatgttgtctaatggtgttataatattgttgttccagtaaataactactgaggaaaattaaggcaagtctgaagccttttgctggttacagctgccttggacgatgctgtacacacggcggctacttactgtctagtttatggtcactgtcatgagtcaccgcccctctcctctacctgaaaaagattctggttgctcctcggtgttctccatctcagtgagtcatgcctccctcttccacatcctccaacccttccgtcactgggtcctgtggattttgttacatgaagaggctcaaatcttacttctctccttcctaagtctaggccagtattatctcacacctgaattacaaaccaacaggtcacccagcctccagcctcaaccccagcagccacacaagtgttatgaggtgcttatggtgacccactaggatgcaggctaaaaagatgtaaacattcattcacctttgtttaggtcatttccctttatattcagctgtattttgtacacagtgtatctggctcagttgtgcatgtttatatgctgtaagcatgtattttcaaaaatattttattgataagacaggcaaccaaaaattttgattgtgaacaccaagtagatgtttctaaaatattgttttgattgtttccctctcttgtttaaaatccttcagtggtctttcactgcctgtagcatattttcctacataacctgccaacctttccagactgcgttctgctgactgttccagcactatcacccatcggcccaagtcccacttctttagcctctaggaccaccatgcagcccagagaggctactttcagcccttgtgggggctgatcctgtggtgtgtgctggagccaactcataacaggtcctgacagcttaatgtatgtatctcttcccaactgtgcattcagctaatgccaagttagtagcttaaaatgggccatggtgggattacttacagcacggaaattggaaaacactacacatcaaagatttcttcttttttttccagaaagctgattgtcgaatatttaccggcacaccattgagctgatccctcttcttggaacgtccttttctagactcttcactgtgccctgcttcaatattcacttcaagcaacataccatgcaggcagctttcccttactctcctttgccccttcctgcattcatgcctcctctctataagctccttaggggtagcagtcatgtctgagtctccctgcgttcatggtgcatagaactgttccaggtgctgagtatgtgttcagggaatgttcgttaaaactgaatgaaatttctgatacagctggaaaacctccatgcctatagcccccgtgtgtcctggtgagctggtttgggagagttaaaccctagggacagctagagcaggaattaggaaattttcagactgtctgactgaaaagtggccagatttacagctcagctcaaagagcgcgtgccaccatcctctttcttgctcaggcttcagcttttcccaacatctctcagcgaccctgaatggcgtacaggctgctatagggagtcagttctcctgctgaggaaatgatcactcacaccacatacctgaacaaacagctgttacagaaaccattatgccagaggcaaggattatagaaaagtgtcccattagatggcaaatggaaatttgttttccttttgcaataatctcttataacatttatcactgcacaagcaagttggtacttgaaggatacatctagagtcattctaaatagagaacttcagatttcaggcttccctgaaggaggagaggtaaaagccctttggaaaggagagcagagacatgtcaagtcctgccaaaaagataccagcgtgacagagaaaaaacatgagatctggggatgatgcctgcctctctgcttctcagagcagaacccagacacacaaacacatttttttttctcaaggtattagcaaaatcctgacttcttagtgggaaatgggggaggcagatgagattagcttctggttcaggaaggaaggctaccttttggacaagtttttgtgaagactctgtaccctcacaaagggcaaagaatggctggcttcagagatccataggaaggagcatacaaaaaagagaaagagaaaatatagcctagtgtccctctgactgaggcaagaagagtactgctaaagtccccactcaaagctcaagacagcctaaggctcaggagaatgggtgaaatagatttttggtttctctggtctcaagagaggctgtggcatcccagagacctgggttttcattctagcccggtcatacatccactagctgggtgattagggatgaattaattggcttcgctgagccttagttttctctgctttgtaggcacaatgatatcttccacacaagatggtgaaaatcaagtagatgtgatggtggattttatgtgtcaacctggctaggctatggtgccctgtttttgatcgaacacctgtctaaatgttggtgtgaggtttatttttttcacacgtgattaacatttacagtgaatagactttgaataaagtagattatcctccatattgtgagtgagtcccatccactcatttgaaggccttaagagcaaagactaaagtatcccaaataagatggaattctactttctagccttcaacatagaaactctgcctgggtttccatcctgccggcctttgctatggatttgccagtcctcacaatcactttagccaatttcctaaagtctctccctacacacacacacacacacacacacacacacacacacacacacacacacacatcttgttggttttgtttctctggagaaccctgtgtgatacagtagatgacaagtataaagcacctgacatgaacccaagcacagagattgcacccaaggcatagtaaggactctgccacctaataaattattcatttctgaccatctttaccatctaatttgatagcttctaatgttgtcttaactagcttgcctttgctaattatgcaggtcatccaataggcccccaccttaaatactttcagtttgattataggctctaattgtacatctacttccatggatcttaaaactggatgcacattacaatcatctggaaagctctttgaaattatcagtacctagactccatcctctgatatttttattgaattggtgtgggatggattcaggacatccatagatgttaaaagctccctgatgactctaatgtacagccagtgttgagagccagtgatatagaagatgccaaggtatacaacactaatttgccagaagcaaaggcaaatttgacaaggatgcctcctttcattcaagcattctattgccaaataagtgctcttccccatcagtgaaggtactaccctcacccagtgcccaagccagaatactaggaatcatcatcaattcctctctttcctttacccttctatccaattcatcagtgtccaaaaatcctgcatctgcttccttctctccaattccactgctcttcctagtccaagctccactatctctttcctgggacactgtatacttctgtacggtctaaatccaatcaggacggtgaaactatacagtcatttaaacaggaaagtttaatataaagaattattaactagcagttttgtaagacaaaaagatcaagagagctctaacacaacaatttgaccatacttaacactactgaattatatacttaaaatggttaagatggtcaatttttagattatatgtattttactacagtgaaagaagccagacacagaggagcacatattctagaaatgtccagaaaaggctaatctatagagaaagtagattagtggctctccagggctagggatggggatgagtgacttctcatgggcacaatgtttcttagactatggagatggtttcataactttgtaaatttgttttaaaatcattgaactgtacactgaaaactagttttgtggtatgtaaattttactctaataaagctattttgtaaaataattattaattataacaagtggctggattaataagggattggctaggaacgagtaaaaataactctaaagaacataggaatcacagatataaggaacctctaagagtgtcatagagtacccagtgaaaaacactgtcatgaatataaattagtatagccactatgggaaacagtatggaggttccttaaaaaaaaactaaaaataaaactaccatatgatccagcaatctcactgcttggtatatatccaaaagaaaggaactcagtatattggagagagatctgcactcacatgtttactgcagcattattcacaatagaatgtgaatcaacctaagtgtccatcaatggatgaatgtataaagaaaatatgagatatatacataaacacacacatgcacacacacacaaaatggaatacacttcagcctttaaaaagaaggaaatcctctcatttgccacaaccacagatgacctggaggacattatactaaacaaaataagtcaggcacagaaagacaaataccacatgatctcacatacgtatagaatctaaaaaagtttaactcacagaagcagagagtagaatggtggttaccagaggctggtggagggtggggggaaaggggagatgttggtcaaagggtataaaagttagacaggaggaataagttcagatttattgtacaacgtggtgatcacagttaataacaatgtattgtatacttgaaaattgccaaaagagtagattttaaatgttctcacaacacacacacacacacacacagaagacaagtgtatgcagtgatgtatatgttaattagtttgattatagtaataatttcataatgtatatgtatatcaaattatcacattgtaccccataaatatatacaatttttatttgtcaattatatttcaataaagctgacaaaagcaatgcatctatcaaagacaatgaggttattgtatgcaaataatactttaaaagaaaacaaagcaaaacaaaatccaactgggctcctctcaaaaggacacagaaaccaacacagaggggctacctctgaccaaagaaaagataactacaaataactacaatagatttaaacaaatcaaacccatgtgttcatatatcacctttggaagatgtcaggaaaccaacatattctgaaaagacatactgggaagatcttcttcataaagaattccagctaacaaatgtagaaggaatgacagcattgttatatcagtattttgcagcttccaatgaaataagaatgcagacaatgatcaacaatggcagctgttaatagaatcattaggtgaaaggctctcaggcaactttattgtggatgtgtgagcctgacaatgcccaaacccaggaagcaatttcaacatcacaaaaaacataccccctgccccaaccctcccccgagttggatataatacaaacacctgcggtatgagtatctatgaagtgttttgcactacaacattcaaatctatatctggtcaagcctctctatatagctattagtttacagaaaattcaggggtggaaggttatgttaaatgacactgtgggaatgcaactagcaatatctggactgtggaatattctaaaggacaaacaaccaggtttcatcaacaaataaatagcaagaaaaatgggagacggagagaggaaacctggagattaaaacaggctgatgaaacctggagattaaaacaaatgagtaaaacaaatacaatacgtagatcttttggatctgtattattaaatgacattttggatccacttactgaatgacatttatgagacaatcatggaaacttgaatactaagtaaatatttgattataagtaagaaaccatttttagatgggataaaagtactgtagcttaagggaaaaaaagagccctaataatttaaagatatatactgaattatttaaggataaaatgatgtattttgtatttgctttaaaacaatgggaggataggggattggggaggtttatagataaaagtaagttgggcacatgacaataaacgttgaagctgagtgatgggtataaagagtttattatattattctacttatatacatgtttgaaacatcccataatgaaaaatgttttttaaatgggagaaataaataaaagctctcttgtatcccccaaggctgagacgcacatcttgttagagagaacgtggccatggctcattgagtggctggtaaacttgctggacatccattctctggaactggtcagaaactgccttctaggatgctgaggaaagctgttcactgggaggtgtctcaccaaaagtgcccaaattgggtgccagaggaaggtgctggctgctgggcactgctgatcactgtccactgcaggatctgagttataaaaaagctgcaagtactgcaagagaagctggtcatgctgtgggagctgggcactggggaagccacacatgcttcaggaatcagacgctagaaaagccatgttcgctgcaggtactggatcacggagaagtcatatgccctgcagaagccaggtactgggaatctatgtgtgctacagaggtgagatatggagaagccatctgcaagggccaccaagagcctgctgaggcagcacgctagaacaaggaggaaaaacccattccctctggcaatgtctctccagtgccctctcctgacagagcttcagcgagcagggacaaggaaaaaaatatttaaagggcccagatccaattccacagagcaagcaagaaggataagcttggagctgaggagcaataaatcaatgattcctcacgaatctctctacttctgttcttgcccatcggcagcctgttcacctcatagcaatcacagtaacctttttaaaatagaaggcttgtctcatcatttcacttttccttggaataaaattcaaactccttctgtggcctaaaggttctgcatgttctggcccctgtctccctttcctgctgatggcagctactgctccagatggcctgccgctgccatcacgctggctgcagcagggaggccctgccagggctgcacactgtgtggagctggcaggagtcagtgacaagtggtagccctgtcccttctgagttggagtgggagctccccaggtgtcctcactgtagaccatggcctcccactccatggagcaggcaggagccccaacctcctgggtggagctgcagctacccaagttgtggctacggatccaaacctccatatgctgttggtcggggggagggggtgccagagcaggcaggattcctgcactccccagtgcagctgtagtagccccatgccctccatggtacagctgcagctgcccaaaccagcagccgcagtctcaggcatccctgcactcttgggggcctgggaaggccctcctgcccttgcaggctcagaaacagaagcacctgctcctgctgcctggcttctccctgctgttggtgtctgctctgatcttggagcaaagtcagggcccagctggggcactgtgaactgtgaacggcaatagaaggcagacagattcctgggcagaagggggcgggtccccagtaaggccccaccttcaggccagggagggcctgaaggctgaaggctgggctgctggtcccatggatcagagtggggacttatggtgccttttccagcccactcatggccgcccatggaccaatcagcacacacttcctcccctctaaggtccacaaaaacctggaaagatcaggcagaggatgaccagctgcagagaggagctaccctgtctgctgagagctgcagagacagaaggatgacttgccagcagagaggagctaccccctgcgggtctcctctgagctgtggtaacactcaataaagctcctcttcatcttgttcaccttccacttgtctgcatacttcattcttcctggatgcaggacaagaacttgggcaaaggtgccaccagtttccagccggaaaaacgactcctcaaagtctcccttgcttctgtttcatgaggccatccttctgcccagaactccttcttatcctgcccttgtcctacctcctggccagcttaactcctacttagccttagattacagtccagacggcccttcctcaaggaggccttccttgacctcaggctgggtcagctctctgagcattctgcccttggcctttggaagtagtcatcacacttgaagttacttggcccatgtctggctaccccacaggactgtggattccatggggaaagggctgtatcagtcagtcgtggtcatagcatatcctcagggcccagcacagtgtctgacactcagtcagtgctcagcaatattgttaaataaaatttaaatgatggtagacacctcactgtaactgcattaaatctgttggggagaactgtgtttgacaaactgaaccagaagatgtctgaagagagtgggtttaatcagggaaaactcctggaaggaaattatattttatgccagacaagaaagggatggtggacctagattggcataaaattgtggaactgacggatggaatagagtacttgggaagaacggtttgactaaaacaaaaacatcgaagtggagagtggtggagatgcagctagagaggtgagggtgaaatcaatagcagaagggacatacccattcagcagatcctggagcccctgaggatggttagagccagatgtttttggaagatgaatacggcctccgcatatctgaatggggtgcagggagtgaagatagaacaagctgggcaaaggagggctggtgactggtggctaaacttaaactgcatgccagtgaaggtggaagaggaagggggaggaagggagaaagaggtgcatggattacagtggcaactccaggggtggaaagaaaggtgattatcccatattctggactctgtgctgggtcccaggggtgcaagagttgtgctcatctttttatagaacttgtcagtggcagagacagacattcaccaaatattcagacaaataaatattaccaactgtggtagctgctaaggaagaaatttgcaagctgctcagaatgaagcccaagaagcctgacctcatccaggcactcataggaggcttcttcgaggaacggatagggaggctgagatcagagttacctagtccatggcagtgggtagcgcggcaatggagggagcactccagggagagacaacctcatgttcaaacacaggtgcctgtgcatacacatggtttgcacccactctgctatccttggaggtcctaagggacctccaggaacagcttggaaccagcaagtcttactcactgtggtacatttgtcctcagcgtccactaaaccctttgggtaatctctgaaaatcggtacacctactcacaacaaacctattgacttcacggggaaaccaaaacacagaaagttgaagtgattgtgctgaaagcacagagagggagccacgtggtctctaaaggtgctatttgggacagattctagttgggaatcaagtaatcaattaggtcagcaaacggtcaatcggcctcagccattaagacaacaagttggtggcactgttatcgacacagccacaatgacttgaagacaggctcagaagcaaggccatagctatcctggtcaataaagcacctgacgaagcaagtaattaggaccaactgtgtttcatttttcacctcctaagccagagtggccctctagacacatctatcaatgaaagaaggcagggctgagggtagacgtttaagacattctaggggaattgagagaaagaagagtataggcccagaaattccacataagctgtttcaaaacttccaaacctctgaagtatgagaaaataggaactgaggaagcaacccaaaagatggcccctccctccacccctctccacagtgcaaagcattaccagcactaaatcatcccaagtttggtagaataaatcactgcatgtttgagatggggggagaagtagggtctccatgtctccacaggctaggcttggggacattgctgacccttcccagtttccatccttccctccctcccaccctttctctccctcctaattccagacacacaggagatttttcagctcacgagtcgactgatgatgtaaccccttccagtctagaccagaagtttcttgaaggaagagacagagcaagaatcaactctgcgtcatttccatgtctgcaaggcctacccagtacctggcactgagtaggcactccgtaaatactgcttttgttgaccccctccccgaattcagaacaaagctgctttcttaggaatcccccagccctgacttagcagcccctgaatcctgcccagagatgtgccctgtactaagttctacctttcctgacagatttctgagcataggagctccttccactcccaccttatttagtcactgccttgtcatccttcctgacctaaaagactcattttgttaaaagtctccttgcaattctggccaagtcatctatctgtgcacaaggaaatctctgggtgctagcttctcctgatctcatgaaaaaccacccagacagtgccttgtcctttctcagagacttatatccctggtgcaagccattgatctattggtggccaggctccccaaggcctcctggatgagggcactgaggtagagccttaaatcaggggaatgatatggacagatgggatataagggaggggattccaggttgacctaacagcacgagcaaggaatggaggtggaaaaaaaacagcaattgaaggtaacagcaagttgttttgtctgcttagactccaggaccccagaaaagaagtgtggaagatgaggctagggagggctgcctgagctgccattgagggcttgcactttgtgctgagggtggtgccaagcttctggaatgttctgagcaaaaggatgatataagcaaatttatacttgaaaggctccatatggctgcagtgtggagaacagactgcaggagacaaaaagtggtgttcggaagactactcaggaggtggggatggttgggcattgagatggtggtgtcctcaactagaaggaaggtcctaggctgaagagaagtagactggatcaagagataattaagaagataaagggatggaacatagtgaatgactgaattcaggatgtaagagccaggaaataggtgacgctttattaatccatgtaatacattataatttatgaatatataaaatacattaactagctcttaccgaacgtcatgtatatacagagttttgtgtttagaaataggaacacacaggtacataatacatagtgcctgcacacaaatagttccaggtctaatggaaaaacaggacaagaaagtgccaatgacaatgaagtatccctagttgctgaggagcacaaaggagaggctccacatcctgcttcaggaacatgggaaggcaaagggggaaatttgcataggagttaaccactgagccaagtgttggtgggcaccaagtgaaggagaacggcacagttactgcaagcaagtacacagcatgcgtgaaggcagtgagatgtgaaacagcatgatgcataagtggagccagggatgaggaggatggtggcaccattagctgtgatctgggatgcaaaaggaagaacagcttgtggtggtggtggcaggtaggggggagggagtgctggactctgtcttggacatattgtgtttgtggtgcctgagtagtagttaagtaatctctgcaaagagctctcttgtggagatgaagccaggcttaggagggatggtgatggtggctcacctaggcaccttgcccttcaccttctcagtagcataagaccaatggagcttagcaggactgagataagggggtggaggctacccatggcagtgccttttgtttgcagggctttgtgattctgcagcacacttatgtttgtggtgagctggccttcctaggacctgagtggttgaggcccgtttgatgcctgaaggtattcactccttctgcctcctgtggtgtatctgggaaagaaggtgagtcaccaagatcatgtacaagatcatgtctgcaaacagcagacaaacaaggggtggcaaagcacaccttggccacctggtcccccacctgggtattttcttagccactgtctcggtccctggtctgggtctgtattcccagtcctgactctcccgcagcactttggctgcactcaaggggaaggttgacttcctggttgccagtgaatacctctgaaaccagggctgcactttaagaatgaagcaagacccagtagtccacagagtcaccttattttgcccattgtctgcctcactgggcaggataaacccactttcgaaagtagtgaagaagaggaaagaggaagggctaggcatgtactaggaagaatgagtctgtaagagtgtcagaatcccaggaaaatgtgcaggataagagcatggagctgaaaacttgactagaaccagattataggagttcccaatgaggaatcaggcctcaggctcagcatcagcgaggtaaactaggaagatttttcctgtgctccaggaagatgattccagtattgtgtgcaaaatgaaaaggaacgagatgagtttggataggaaaaaaggctcattccatagcccaggcaggaagtgataggaacagatctgggacaaggtcaatgggactggagacaagaggacagacacaagcaaagccctggaggtgacaataagtgaccattctgaccaatgactgcaatgtcaatgtgcttggagctcaagcagtggggagtggccttcagtgaggaaagaaaggttggcagaggtcaatcatggaaggcaccttaagccacatgaaggagtttgaactttgtcccagttacagtgataatgtggaacaactggtggtttattttttttttcctgaggaatgactttattatttttgtaaaatttatgtgttctcgtaattagaaattaaatcaatatagacaagtccaaagaacattaaaagtaacttcaacccccacacaataatgattgtcaaggcaagccttactccaatcttgcctttaagttcattattagagatgagaatggatagagagacagagagaggggtgaacaattttccatggtatccatgtgtagatattatctggaaatatatgaaatttaaattccctataatttaaagaagaggcatctcacaagaggaaagaagtaatcagatctaggttgtaagaagatccttctagctgctgatgtgagggaggggttgggaggaaggaagattggatgtcaggggaccacgcaggagacacaaggtgagaatagtgaaagcttgaaaaaggcaaggctagcagacttggaaagaaggggtgaagagtatccccactatatgagcagctttcctaggacctgctttctggtggggggagatacaaaggaggttctcctagatggctcataggtctaaagccttggtgattagggggtgttagttccatgatcagaaataggctaagcaggcagagcaggtttggtgggggagacagtgtttcttctgatgcatgaagattctgtgtctggttgggcatccaacaggcatgtggagatgggaatctggggctcagatgagaatgggactgaagataaggacctgagaaccagccacacagaaatgagcacaaaaactgtgggagtgttggagatctccaagggagaaagtgtcaagatagagacctggtccaaggacagaagcttaagaaattcatctgttaggagatgggagaagggagaggagccaaaggagtcaacagggttcgaaagaacccagtaatcttgtctcagtgttttgttcatggttgttttcagaaactttctgggcaactcaaatgcaaggtgtatttggtgaaagagaagaaaaccacgactacaacatgagtgagggaaaggagctgggaagtaaagaacttcatctcaggagggtgaagttagcagctctgtgcagagggcttggggaagtggaggccaagaaaaagccattgaatttgccagttaggtcttcagtaactgtggtaggatcatgatctggagagtactgagagccaggaacagatggctgggagttgaggagggagccaaggcaaggaagagatgactttgaaggcaaacttcactctccaggaaactaggaactacctaagcatattctaggctgcaagactagagccagcagagccagaaaggctgaaaataagcatgggtggtgacaactcacaaagctgggacctcaggaagctgggagagagttccagtagagagggctggaccactggatcaaggaaagaagaaatattgaggtggagaaaatgtcagcattttaggcttgacagcataaattataccacttacaaccaccaccttttaagcatatacactgtgctgtgctgagtgtcgtctgggtattatttggtgtcattttcacaagaacccgtacggtaggtacagtgattacccatattctacagaggaaggaaataaaactcatagagatcaaatatcacattgctggccagtgggagagacaggactcaagcccaggtctgtgagacagcatggtccaagttcttacggaccactgcacactgtttcatgttaatggcttcacatgagtcaaaacaggagataagtctcctggggtggatgaaaaaggaggtgaggctgtgattgggtgtgagagacgtaggaaaaggcctcagaataacttatttggacacagaacgaagtttgggttaaaccagatgtgactagcaaataaaatgtgactggcagccttgccaagagtcagggaaaacccagttgccttgtattctccagcctttcttcaatgcccagacacatagaaagataatttctctttgcctattaaaaacctgagtttcagaaatagtcagtgattttttccatgcaggtagccaaaccaggagtggtgctcaaggcttctgactccaggggcaatgctagttcttctagcctagcaggtgcgtgcacacagatagctgggaatgccaaagcaccagctctcaccagtgcacgggggagcacagattagaagctgcagttcagcgcaaccaggctcactggagtctgccatatctggatctaagtgccggctctaccacttattgaccatgtgcccttcaatctgttgcccaagctctctaaaccatcaaatcctctctcaactggaaataataatagcacctgcctcacaaaattattgttggaataaaacacgataacccatgtgaggtgcacagcacagtgcctggcactgagtgagaggtcaataaatgctcagggcagttgtttctgctgtgtggttgctgttagtggggaggacatgacttagaggcagacagtctgggctctagtccctggctgaccccttaattgctctgacctgaacaagttgcttcacataggagacagatttctcagctctaaattgggtataattcacgggtggctgaggaaatcaattaagtagtggatgggaaagtgctttgaaaactacaaagtgctccacaaaggttagttatttaattctaccttggaactaaaagatcagccttctagagaaccaggcacaaaggatgagaagagaggaaaataactaagttaatgaactccataaatcaaaactgagaaagtttagaagaagaaggaaaaaaagattttctacttctctgagatggaagaaatgcatttaattccaccaagcgtgtatttcgaacctgttccagatgaggatttgggcaagctctgttgagggatcagggctgagtcagccttggtccctgtttgccaacagctcccccagggcacttgcacatacctaagtctgccaccaaacagaagacaagtaaagcggggagcacaaaaagggaaagttattccaactgtgaggcacatatcagcgcggccatcttggaagaagtggcattagactgggctttgaagaatgagtaggtgatgaatgtgtgaggtctggggggagttgtcagagggatgaaaagaaaagcttgagcaaaggcacagtagcagggaggggcatgagtttggggagcagcaagtcaatccatgcgactaaagaaaaggtttcactagtgagggatggaggtagcaggtgaacctggaaagatagactgggaccagctcagagagtctcaaggtggatgaaggtcttgagctttgttctatagccagtgccttccaactgcgttggcctggcctggcctcaaacagttttctgagcaatgtaggtgtcagaaaataaaagtttatttgattgatgagatatactccatagttggaacttcaagctagcttgttcccaccagagcagaattgactgtagccaacaggaatggttgaccatgtcctctgcagctcaggaaagcagttctctatgcaggtctctccaggaccctaggaagactaggctctacctgagccagacacagctctctgctagagaattggaggccccatgagcactatggagagagcctactgattcctatgttcctcagtttgccttaaatgtttttttcctcgtttgtggctttcttccccactgtctggcccacctgtctcctggtcattcctgaaatctggtactctatgttcactttaacgccttgatgacctagctagccttcgatctttgccaatttgtcaaccatttctgacctattccttagtttgccccacatgcacctccctccaaaacacataagcaaccaaatccctgacaatatgcagaggtgggcttagctgtgtgagtgcagattcttccatcttgccaatattggggagccattctgtctgggtaggtcagccctttacaaacctgacaatgactaatctgccaagtagctgcttcactgttgaaagattcatagctttgttcagaaaaggtcagattcattggttctagtcaattagaggataatttattgtgtctcttccttctgtgacctccaagaccatacgtagtttatcagcaaggggccaatctccaaggcaaagtcaggcacactgataatcccccaaaaggcagaaatggggccagtgagctacctgaggttctctggattggaagtctcagctgggtcttgtttcccacaaatccccatcacaaggacgttaagtgggcaccttgtccatcaaacagatttagaattgccagtattgtacaaatgtgagattgtgtgggcagactctaagaagatggctatttcctctctagtatcatcccacagttaggacggccaccgagtagtaggtatcagagccttggttatgtctttctggtacaaacagtgggactttgttggggaatggctaaataaatgagattaataagctttactactaaattttaacctaacaaggaaagcactttactaatatggcgaagcaacaagataaactagaatggctatttaaatgtgatacaaaactaaagcaagatttagggaaacacaagcccctaagaactttgaagaaaaaaaaaaaacacttacttgataagcctaaattcattaattctagtactttccctctctttctcttacttaatccactggtttctatgccaggtttatactaagcttccttcaaatttttgactgtctgctatctcaagcaaagaatctaagaaagaagaatgacttggccgtatttcctttgacaccactctcccctggtcatgagctgcaacgttgaaggaatcattcttgtggctcttttctaatagccatcttctgaagtcattaatcagagctgtcattttctcctcattatagtgctcctgactttgtttccaaggaatctgaaagaagccaaaagagaaataaagatagccatgtatgggctactttccagcatgaaaccctgtgattgttttttcttcagttaagagggattaaatgttccttctttaaaactaagtcccttgccctctaagccagagtgtatggtattcataatatatgttggatgatcccttagaaattaccactccctaaactttttttctgttaggatttggacttgggaaactgaataatgccagaatggaatgtttaaaagaatattccaagaccataattagatttctaaacaagcatacataaatgtttttccacatgtgctgtgaaatcagacccagcgtcagagtcctccactgtagctctactctagttccttgtaggaaatgcccaactgtggctttttccatggggcaggaatagggttccagggacatgagagttgcttcatctacagcctctgagatgggaaagactcatttaagtctgattggaagataggcatccattgtggtttataaaatttttttagataaaaactaggaagaaggctttggagacaagaaattgtcactctgggaaatgggagagttcaaagaaataggaaaagtgtgatgagcttttccatccgggatagtagagaaattctgaggcatgggattatgggcactatcacaaaggaagttaaggaaaagtgaggagatgaaaaccagacaaaaagggttgtataggaggcctttgaaagattccagaatatctcccagaagtcctcagtacaaaaagcctgttacttctttaggacaggagaaatgaaattgggagccaggaagactcacatgtcattgtccaaacgaaggagaggagcacaaaagggaaagaggagtggagtgcaagctgacaatggccatagagccaatggaaaggaagtgaggggagttctgggaagaaggccagtcacaaggacacacctggagagtttcacagaacccagaggtccctattagccctttgtccatctctgtctatagacttatctgagaccctgtgagtccttgcaatcacacctgccatttctaccatgaccagtctgggactcagcttccaacagggcctctgcccactttggactggcgtggattttcctaaaatgcctatctctgccccactctttcccctaatcagcctctgtctggccagacatctacacctagaaacctagatcttcagcccagtcccagagaagcctgtattccatttcagcccctatcctgcatccctgctgctaactttgccgtttggggtttcttgcctgcctcagccactcatctagcttctggtcttagctgatccactctgaggaaccttgcaggtgagtcctcttccacactacatgaccaaccatctcaggaatgactctgaatgcccagaagtttggtatctgctagcattccttctttcatcgctctctgtttccagccttccactgctacctctcctggtcaagtctaagcagagactgcctggtcccagaatctcagtgtgtcactcctggcctgtggtttggccttggctgttagctctgtgactcatggcaatgaccgctggctgaaccccctcactgattattcgcagcaattggagcaggcctccagttcctggaggccttcccttgtataggtcccagcccaaacatcggtgtgcagaccactgtcttccccttggatgttcttcccgttttccagtcggcccatatggcagtgacaatggagggccctagagaagactttacttcctctttcatgtggaggttacagaaaacaaattatccaagttcttgattcataggaccaaagtctgatggcatatcatgaatgaaactaaggaggcttgagaattctgtccgtctcaagcatcaccagagagttctctgactgaacttgtattgccccaggagcactcagatagccagaggttattaccagcaaaaaagatcaaaaagggcctttccataaatggcattagtgtgtttggatattggagctaaggacagctaacaacctcctgatgctgtgactttggtggccaaagtattcacgtgaataattagaattataataccacctcccaaatcccaggcttacctagaaatcaacatcccagatcatcattgtctaatagtgactaccatattggacagtgcagatatagaacattaagcctttccccaaagggagtttctgaaataaagataaagcatgtacaaatggctagtgaacactcactagccaaaggggccagaccagaagagaggggctgttgccacatgaggagaggaagagagatccttgtggtttgttattccctggctagctccctgcccagtgagcgactttggactagtggacccaccttgcgttgctacatccctgccttattagccacttcaattttcacaaaatgacaaaaactagaaaattttatcgtgtgtcatttaggaagatttaaacaaatgaagagagtttattcccatatgggaaacctgattaccaaataaatgtcaattttctccaaatcaatctgcacttaacatatatttccaattggaatttggggagcttaggtaggtttattctaaagttagtctggacaaattcaattcaaacaaactgaaagtagcaaaacttttaaattctggattatcatgtgttaatttcatgcatttaattcaaaacagttcatggaaaggcatagaatatagatcatgcctcattctttgtttgaatggcatgtggcccataataagaaagccacagaagtaaaaacaagttggcttatattttcatattaaagacagagttcaaaaactaaaaaaaagttaatctggaatataaataatataatagccagaaatatttttaaaaaataaacaaggggatactttccacagaagatgttaaaatgtattctaaagtcacagtaattaccatgggatgtgacagaagagacagattagtgtacagaatatgtctacaagcagactcaaatatatgaatatttgatatatgataaaggagacaactcaaatcagcatagaagtatgttgagataaacggagagacattcgggggagaaattaacttagatcttgttacgtagacaaaaaagcaaaataacaaaataaagccacagcctaatactaatctctttcacagtgtcatctggagaaagcagaaatctgaatctgaacaacactgcactcttttgcatcttgattctttcacttggcatgatgcttttgagattcatccattgtgttatgcgctttggcaattctgttttattgctgagcagtgcttcattggatgaatgtgccatggtttgttcatacattttgtatatccagtttgtatatccacctttatgcggtttgcttatcattctcccattgatggactcttgacttgtttccagttttaggctattattaatattattaatatagctgctatgaacattcttgtatgattctttttataaacatatactgtcattgctcttgagtaaatacatggaggtcaaatgagtgggcctagggtaggtggatgttgagttttatgaaacactgttagacttttcccaaagtgattgtataattttacattcttaccaacaatgtgtgacaatttggctttctccacatcctcatcggcatctggtattgtcagtcttttcatctttaaccaccttggtgactgtgtagtggtatctcattgtgattttaatttgcatttccaagatgacaaataatgtgagcaatctttcttgtgcttattgaccatttgtatatcttcttttgtgaagtgttcattcaataatttttgcccacatttaattggttgtttgtcttttaattattggattgtagaagatctttacatatcctgaataccagtcccttgtcaaatatatgttttgtaaataatatttcacaatatgtaacttaactattcattttcttggcagttttttgatgagcagaagtttttaatttttatgaagtttaattgatcaattgtccttgttaattctgttttctgtatcctcagaaacatttgactagcctaagggatgaagcaatgcttttctaaaaggtttgtggtcttttactttatgtctaggtccctggatctctccccagttacattttatgtatggtgggtgtgaagtaaggttcaaggttcatttattcatatggatagctggttcttccagtgccatttattgaaaagactttccctttcttattagattgctttggcacctttgtcaaacataatatgactatataaatgtgaatctatttctggactctgtatttgtcacacaatatattggtcaagacttatgccagtaatacactatctttattaacatagctttagagcaaatcttgaagtcaggttaagtttcatcctgtaattttgctcatatttttcaaaattactctaggtttctaggtccttagcatttccatatagctcttagagccagcttgttaatttctaccaaaacaaattgtcatgatgatgacatgcttgtgttaaatctataaatctattaaataaaatctataaatttgtaaatctatttgtgagttgacactccacaaatagtgtcttccagttcatgtatatggtatatttttccatttctgtaatgagtttttaattaaagaagtgtctttgtcagagctgtgctttaggaagataaattttatagcaatatgaagtataggttggactggaagcatggataccacttggaatgctattggggttatccatggacaggaaatacgtgcttgaaaaagtgtagtattagagtggaacttaggaaatgcattccagaaatagaatcatcagaacttggtgatcggacatgaagggtgagagagatgacagagacttagattattctatgttttcgtcctggataacctagaggaagacatttccgtaaaacattaactggccttcttgtagaagtattttagtgcatattacttaacagagcttgtgcttggctctggggacatagcaagagcaaaagtatacatggcccccaccttgaacaccttgtggatgataaagatgtgtattaaataatcacacaaatagaaataaaattgtgactaataaaagtgctttaatgctagcacacctaacacttagatcttggtttctaataccattctccaataaaaggaaccagagctccttagagaaaagacttattctaggactagaaaatatacaggataacgctaaagtatcttgtagcaccagaaagtaaaataaaaaagtgctaaaacaaaacaaatctttaccatgatgggaatatatcaaagtgacacaggagccaacaaaatgacttctcaatggccaaagctagagtaatataagcaacaaaataaataaaacaatattagaatataacccaaagtataaaataaatatccctgagtatatatcaatatacattaattaattaatggggaagaaaagatagcctctcaggcatacaagttttaataaattatgtaacttctccaccttaaaggaagaggggcataacacccactccttaaatgtgggttgcacatagtggctttcttccaaagagtacagtatggcaaggggggaagagtaattttagaggtggagacacctgatggacataaatttagccaggtgatcacaatcagaatcaatgtcatatatcacgtacacagtatgttgcctcgatatgatgtgatgaaaatatcactttacttccgtgattcccctcccaaaatacataaccccagtctaatcatgagaaaaatatcaggcaaatcacgagagagacattctacaaaacaactgatcagtcctcctcaaaactgtcaaagtcatcaaaaacaaggagtctgagaaattgtcacagccaagagaagcctaagacacgacaactaaatgtagtgtggtatactgaaacacacaaaaacattatgtaaaaactaaagaaatatgaatgaactacgaactttagttaataacaacatatcaatattgattcattattgcaacaaatgttctgcactgaagtaacatgtgaataataaagaaaattgaggtggagaggtacatgggaacactgtactatctgctcaatttgtctgtaaatcaaaaaccgtgaaataaagtctattacttttttaaaacaccctctaaaagagacttacaccttctaaggggtatttgaagtcagagaagggcctcctgaggaaattaacactttatctgtaatcggaaggatgaagagggattaaggagatgaagatctgggagaagaatagataagtgtaaaggcccttaggtaaaaggaagcatgatgtgttcaaggaacagaaataatagtgttgtgatttaaacagcatgatcaagggtgaatatggtacaaaacatgacagaatgaatagacaggaaccagaacgtgcaaggcttttaggccatatatagtatttttgtctttattttaagagcaatggttgtaagtggcagcgagtgggaggtggcaagaggaagagggagagggaagggatgctacctcaattttagtttggccaactgagtgcctgaagcaggattcactcggatggggacactggaagaggccaggagatcagttttgcacatgtgggatataaggtgcctgtgggatatccaagtgaaggtgtctagtagacagatgtacaggtctggggtcagaagagacttgtgaattggagagaagttgttgagtttcctgcatacaggtgataaatgaagcctcgggcatgaatgagaccacctagggtcttgcattcaagtgcctaaagataaaggtgggaagtcaccaacctgcaaataaccatgcactatccagccatactgtgtggaaggacaacagaagaggatagaggaaagaagtctgggcaacaacagcatttaaaaagaggaagaatccatgaaggagacaacaaagacaatctaaaggaatagtgtgatgtcactgacaccaagagaagagaaacagcagcttctggcagctaggaacacaggatccatggcttcctggcccatctccattgccatcaagttggtgactagtaggctaggccatcacgactgactggagctagagcaagagcagagtcagtaactacataaacacaccttctgaatctcttctgggaagagctgtgagtccagagttgaggttgcctccatgcactggaactgccgagaggccgactgaattatcatggcccatcctgcctgcacagaagcagggtcttcctgtctcttagaggtgggcatggtgtccttgacctcaactgcatacatgtaaagacccaagtgttttacacaagtgtaaagacctctgttagcaatagctttgcctatcctcattgagcattagagctccaaacagggtggcagcctgcatgggcacccactctgtgcccaggtctgtactgggcttccatgagactatagagatgaaatcacaacagttttgtttttgaagagcataagcaatcacttgaatacaaactgagcagactcctagagacccaagaagagaatgagtagaaagctgcacagtttgctaggtattcacattatcacccctaattcttacaaaaagtcctacatgatagatcttattcttattactccaaaattttaaaggaggcaactgaggttcagagaagcaaatcagttgatgaagggcaagttttgtaaatagaaaagataggattcatacccagatctttttgactctaaagtctgcctcttttaatccttaactctgcagagctctcagtaaacatcaatcctgttactgaccccatcatctgaagcagataggaacaccttccacaggatgagggcgtctggctagggtttctgggaagaggaggcattagcagagtggaagataagcctggatccctattagtgagggcaggtgtttaccagggttcaatgtagctcctctattcctgtatcttgtccaggctaatccagtcctggatgatgtagcatttcatcgagtatgccctttgcctccataacaagattcccggcttcttcaagcaaaatgatggattggccttcggtgtgtttagtcactcagctttgaaaagacatctcagctgggccaactttcaaatcatttacaggaaaatagtcctgctgctaagacctgcattctggcctgactcaggtgttaccatgtacaagtgtccctgagccttggttttcccatttataaaagacagatgtgttggttctttctatgctccattgattgaggacagattagtcattcagtcacctaacaaagattactgaggacctccaatgtgccaggaatattgaggtacaaagtatgcaatgctgagcaagacagaaaagatcttgggccttatggggtttagtgtctgttgggagaggtggccatgtgtgcaggtacattagcacacatcgtgatcacaacatgagagccaagagaccagagtggctaattctgctgcgggttggacacgttgcctttctcaccattacctttccctggttaacttctacacatcattcattcattattcattcactcccctaagcattccgtgagtgcctgctaagtgtcagacactggaaatacagtgaagttcaaaacaacaatgacctggccctggggagcttacattcaagtggaaaagatgaacaataagcaagtaaacaaacacacagtgctcatagccctgtagcttcttcagtttggctggtttcaagaaggcatctctgaggaaatgacatttgaattgagaccggttaacaaacaaagagccagtcacataataatctgggaggcagagttttctcagcaagtaggaaagcaagtgccaaggccctaaagtgggactgagcttggtctgtttaaggaaaagagggaaagaaagcacatgaggttggcatatggagaatgaggggaggacagcaccagatgaggttagcatgttaagtggggctgggtcacttggggccttggagatcaggataggaaaggtgaattttattctccctgcaatgggcagccatgggaggttggagcagggaagtaaagtgatttgcattttaaaatcactctagctcctgagccaagagtgggttgagggcacagcaagaatggaggcagggagaccagttacagagtgggagtcgactgtggctttgccaatgatgctgtcctattgctcagctcagtaccgtgagccctgtgagaggcctcctctctggttcccgccttctgccaggcctgctgctggagctctgtgcatgtaaaaagtgagctgctggcccggcgaggtggctcactcctgtaatcccagcactctgggagaccgaggcaggcggatcacgaggccagcagatcgagaccatcctggctaacatggtgaaaccccgtctctactaaaaatacaaaaaaaattaggcgggcaaggtggcgggcgcctgtagtcccagctacttgggaggctgaggcaggagaatggcgtgaacccgggaggcggagcttgcagtgagccgagataatgccactgcagtcccgccggggtgaaagagtaagactccgtctcaaaacaaaaaacaaaacacaaaaacacaaaaaaacagtgagctgcttgctgtgacagtttctcccctcctccaagagccaagaaggctcctctggaagcaagaaaataaatgagattggaagctaagagccagaagtccctcctcccacagtcactctggtcttgacttctgccccccaccccttggtgtttgccagaatctctgcctgtttctgccatatcaattccatttcagtgttgttggactacagatgcaccaatcaggcaacttctttcccaaatcccttccaggcaggaaggcccgggtcccttctgatcttgcctcctgactgcagtctagaagagcgtggcctggcagattggccaccagtgcccacatgggcaggacctgtgatagattgccacccccagtctatgcagggcctctgtctgactctccccacttggaaggcaggaaagaggcccaggcagaggctgggctatgaccaaggccacgttcagaggcggaagccaagccaggacctgagtccaggtttccagactcctaaccccatggctttttctaccccactatgccgccagcccattccaagagagaaaccaagagtctgagaatggctttggagcaggaaaccacaactctcttgccaagtccactttcccatcagaacaaacccctttcattctcctgccacctcagcagtgttcctttctcctgcctgcctatccagatttcactcagagaccattggaaatctggttagcgctggattgggggttgggagagggaagagctaattccacactggagatgaacagcttatgaccagcacatttgggcctctgaactgacaatgaaagcccaggtggcatcgctcaccatcttcacagtgatctgcagatggatgaggacttcattcaagatcaaaagttaagcagagacaaaagggagccaaacacctacttcactctgctacttatctctattctccttgttatgaggaaactgccttctcactcctgggcctcagttctcccctctgtaacatgaaaagctggcctaaatgatctctgactgagaaccttctagtaaggctgctctgcaaactctgtgaggcatgagactgctgcaatgaatgagtggtcaacgtgggaagacaagagtcctagatttcctggggaaagcagcagtctctgattgagaacttactctgttccaagccttgatctgaaacccatcttgaggggaggacagggttgggggagagagaagaattgaggcagctgccattgaagataaattttaagaaaaaagccaagatgttgaaagagggcatttaataaattttgcttggtgatatatatctccctgtctctccttgaaaccttcagtaaaatgccacattaactgtcaaggcatttgctgttggatttgttcttttcgaagattaagcattatgctgagactgccctctacaagggcatggtgccggagcagggagggcccaaagaggccccggcacatttgagtataaccagaagagttttactagcctggcctgtccacaggaggaaggcctgatgatcccccagctactcccctgcccccatctccttttccctcatcctggggccactaggccacagagcacctctgctcagaaagggtgagaatcctcaaagaaggaacaaggcctcgaggtttatttcacagttcagtaacttgaaatggagggccctgggtctcagagatctagggagtcgcatatagggtctaagtttgacttgcaagcatattggcatcattgccacctgggatggactgaacagtgtcccccgctgccgcccaaattcctatgttgaagtcttacccaccaatgtgatggtatttggaggtggggcctttgggaggtaattggggttagatgaggtcctgagagtgtgggccctcatgatgggattagtgtccttacaagacggggagtttgtatttctctctctctctctctctctctctctctccccccctccaccccccagcccccaccaccccaccgaagcatgtgagaacacagcaagaaggcagctgttctttaagcccctaagtttattgtattttgttatggtagctcagcagctcaagctgacaaataaaccattcctggacccctgagaggaagccaaagcctttcctttcacatatatacatgttcatcagcagccctgtgagcaaggcatgaaagacactatcaaccccattccatatgggaagaaattgaagcccaaaaagcaacctcacttgaccaagctcccagagtgaataagcccagtgttgggtctcgaacccagtacttttgagtctaagtccaatattctagtcctggtttctcaaagcgtggcccagggcccccatccttcggatggatactctgcagagtttcttgagcaagaggaattggtggtgtatcaggcttcctaaataacatcaattgagggtgagctcgtgaatctgcattttaaccagttgtcctgtgagtcttaggcttcctaacagcagagaagcagccttagtttcctctggctgccataataaagactggggtcttaaacaacagaagtgtattttctcatagttttggaggctagaagtctgagattaaggtgtgggcagggttagtttctcctgaagcatctctccttggcttataagatggagtcttctccctgtgtcctcatatggtcatctctatgtgtgtctatgtcctaatctcttcttataaggataccagtccttttggattagggcccacccatatgaccctctttgaatttaattacctctgtaaaggcctatctccaaatacagtcaacattctgagatactggaagttaggacttcaacttatgaattttgcaagggcaaaattcataacagaagcctcgatgaaaatgtgatccccaagtcgcaccccctagtgaagagcaagtcatttctttttctccctcttcctcccacatctcagtgctctaaaaagagcaacatgtttcagagtgctggctccaagtgagccaagccaggaggccatgctccctgtttctatggtcctaagcccaaccgatgcctttggggaccctcgggaagctggggctttccctcccgtccatgagagtgggtttgccatgtggcacagtggcttgtgaagaaaagccctgccctcaggtatgcaagtcagctccatccacacgtctttaagagcctaattaatccaaaaccaagtggaaggtgcacttccagaggcagaaaacacacacccaccactctggctcagtgcctgcacagtaaatattgtgttttgtgcccggaagctgacaaactcatggaacttgaatgaaaccatcagggcttatcatttcatgccacctaaagacaccagagaacaaagatggtgtctaggaggagtgcatagggatggcccctcatctgtgcatcctgtgtcttcaggccacagttacgggaggggtggagcaccccagttttgcctacaaggcctggcaatggaagccgcaaatactcaacctgacaggccatttcagtgctcctcctacagctgtacctgacaagctagctgcgctgaagcccttgggcccagaaacctttgctctccaaggccctttaccctctctggaaagcccaagcactctccaagagacagctccaatactagcttcccatggaactttagtgccctctcccctgaactcagcccctggcatagagattctccatttctctactccctttgactcccaggcagggagctcggtctcagtgggaaacacaccctttgctctgagacagtccctgggcaggggcagttctgatatctcgtggaatcagactgcgactaccctccctccattccactttctagttgcccggggctgctgtcctgacagtcccatttcccaatgctcttggacctaaaggcatatgtatgcactagccctgagcatccagggggcccagggatatgacacaggcagggcagtgcagagcagtttcaaagagctgctctgccctggttttcagaagcagaatgtgggcttgtgcacactgcttgccagcctgctagagggcctcactcttgggagtgggagaaaggtggcagggctgtaagagccactgaggcaggaagaggagagaggacgggaggaaaggaatgtgaactcggctttgtagcagacatgcctgtgggagcagagggtgggtggagtgcacagactggagagaaggggcacaaatgagcactagagctgggccaaggccacttcaggcttcccgaggccactcagcttgtttatgtgagctttttacacagaggctgttctgcagacccaggccctctttcatccttgacagtgggagtagactgctggggagatgaggcctcagggccggaatgcagacctcttctgcagagggcctacatttggctgtaagggcccaaccgagccaagccaagctcagcaggcaggagctgagcggattttagcgccatgaaagcagctgctgcaatactgtcctatgaggacagctgtgtttcccaggcagggctcgatgtcattccccaggcatctggtatgggattcgagagccacctccatccggcctttgccttatttacatgcgcatctgtgtccttcacgtagctgagagcccctccaggccagcaaatgcatctgattcctatttctatcacactcgctccacagcccgcagcccagaatccagcaatgagtatgagatggctcaatgtcagcaagggatcctagtaatcccagaaacctatgaagatgaagtgtgaagtcaccactgtagatgtaggtcaggagatcagtaattcttggataggcaacctctcccatgggacacagttttttttttgtttgttttgttttggtttttgctgctgctggagctagggcccgtgtgagagctacgtgcttcttaatccaaaggagaagagctggcttacttcctccatccacaagggatgtccagggccttctaaggcagcattgggctctccaaatccccacacaccacactggctttgcaaggcattgtctctcttttttcattcttctcctcctcctccttttcctccccacctttctttgcatatgtattgactttctccattttaccagcaatatatgctcattaggaacacttgaattattccaaataagaaaaagaagtagaaaatgtcatccaatttccaaccacccaaagatagccacggttaatattttgaaatgttttattccaatatttcctctaatctttctgagaagtgagggtttctgtgtgtttgctttatttctactgcttagcgacaactgacagccaggtgaggaggagggagcagaatgagacaatgtaaatgtcaggagagcggcaattaggtcccagctgcactactgatgtgctctgcaaggttgggcatgcactgaccctccctgggcttcagttttcccatctatataatggggtattggattagataagttcagaggcttcttccagcttgatgattctttgaattcatcaaggaggagggaaggcttcaaggagaaattgttacttgagctgagattttaaaagctttgttaataggtttggaagagggtattctaagttaaccctgttaatagatttggaagatagcattctaagtggaagagaaggcagatgcaaaaacaaaaagcctggaagataaaagctgtccttgggggagagcctctgtaggcttgaggatgtgagaaatgtcaatgggagatgcagctaggaccagacaccagatacctggaatcctttacgttgaaggccctttggatctaagatgggtcctaagcagagagtgtttgtgagcctgtcatgtagagagtggcagttgagagacgagcagggggacagtgccagctcttgctcatccaggtgtgagatctcagacctgccatctggccttgctggccacgctgagatggcagtctgtaggatcaaggaatgctagagccaggagcctatgttcaccatcaattgcaagcatggcacaaatctgagggtaaaggattcaaagaaccttgaatgagagagaaggagcagaagcgccggcaagaaagcaatttggataaaaagaaatactgtaaaaagagtgagatgattacctaaacacagagtttggatcttcctgccatctccaccagccttgtccatgaaagtccgaagctaatctgaacatgatggcagatagaggtgaagatgtttagagaaatcgtcagacttcctaggaaggaaaatggctggggagaaggatgtgggcattcattcacctacatattcaccgactgtctccatgggcccactgagaggcaagccctgtgcgagggtgtcagccaagctcttgaccctctcagccaaaatttcaatctgcaagatgcacatatcagaaacagtggagtactgcccagtactttgtcccaagttaaataaacttggaggaaatcatggtgcttgggttgctgcctcatggtccaaatagcttggcttctcacaaatgttactaactgcattgaagaaaatgtagcctgcatttccatttatccataagactattatcacaaaatacaatgcaagaatttcaagattgaactggaatttgaaagccacttactccagaaccgttatgaccctgatttaaacaggttaacacaaatatatattagtcttggtgtttctaaagagacagttttccaaatgcaagtggacaaataaaggtagcgctccactcacaaaccttctactattttccaccaagcaaattacatagccgggcttgagtagaacgtcctgtggagttgtgtgtggtagccttaaggccttccagaagttttgtatcaagttatattcccagacaacctgccaacatttgccctccctttagcagctggctgtgtaattcaggggataactttatttggcatccccgagagcctattacatctaggggttctttgccatgactgcttgctctcttgcctctcttcttgttctaaagcagtaaagaagagaggagaagaaatgttggaggtcttagtaaatgttctgaagtggtcactccactcagctagcttctaaaactttagacgggtgtcctatgtaaagagaactccggtgctccagaagcagctttgagtctgtctccccgacatctactatgaaaggcagaacctgattggctccatgactcataccccacccagtttgttttgtctcaaataatcccacggaaagccattaaatcatctgaacatttattggtggccattctcttatcctttgtcaacaggagacttgggagtcctttaggaagaccctgaaaacccaggtatgtgatcttgggtgtggggaggccctggtggtaaaggtggtcgcgatggcactggtaagaatggagggttggctgcagccatacttactaaggccaatagggggacctccgccctgtccctggcctgatgccctgcccagcccctttgcctgcttgctttctgcctgccttctttttaaatgcggcccagcacagtgcagaaccctgaagcagtaagagcttttcatggtgatcataaaggcaccattgttatcatcttctttcattatttatttggccatgataaaggcagccccattaacacagactacgaatctcacctttcctctgtctacagttatcactgtgcttgcagctcaggctacagattaaatatctatcatcactatgataaatggcctctgcagtaggggcagaaatgcgaatccaccttcgagcagctggtggcagctaatccagccagggcatcccagtatagggaccccagccatggagaaatcagctttgcctttgtggcgatgtgcccaagctcacctgtggctcatcagttccacaggtcagctcaggagaaaggatgccagggaagtttgttgttaccctgggctagccagtagctctaggagagcaacctcccacaactcctctcttgttatccccataccaaaattgagaccccgactacaagagacaaaagactgggcttgcaacctgggcgaggcaatggctagcaaatgaaaaatatgtggtaaggagttgtggctgactctaacccagacccctgttaggtggaagggagcagcacagaaccctgtgggaagggggactgacatgcaggcttcatatttgtgcattcctctagtgtccctgggaaacaaatccatctctaccacagtggatgaatttgccagtcgatttgtgagtgcgggggcttatgctgtggctcgacagctccatcccaaagtgcctgttgtggctcttctgcttcaggagggaccccaggctgcctccaaaatttttgctgctctgaaagagaagagacaaacacagggttctgaagcctttgggacctcattcttttccatactaattggcaagtttatctctaaggcttttgcagcattgtaatctggctattctcacctttggtgaatcacacctccttgagggagggatccttgatgtttctgctgcctgtggtgccaccaaatgccactacaattctggcaacaggcaggaaggagatgcagcaaacaccacagtctgaatgatgcttaggctatggctcagtgccaggcacaatgttgagcatggttcccttggggctttacgaccttctcaggctgggtcagctctactgaacatgacctccacctccaggacaaggggctagtagcagagggacagcactctgcaaaaggcttctctgcttccagtgtgcatcttaatgaatgcatacctcaggaatcatctgtggctgcaggaagccctcgaaccctgaagccccttgttgatagggcctgggtcttcttcagttcttaggaatggcttgtcagtgaatgaatgagtgaatgaatgaccaacttaaaaagtaaatgagcaggagtgtaagaaaaaggcttctcaaaccctgaggtctccagctgcagaatccttgacacctgctcctccagtcacctggaaatgcttcttcgtactcacagctagaatgcctttgtgaagtccattgtgttattgggagcagggagcacagaagacacatttttatgttgacaaaacccacccctcaggcagccaattgtttcctccaacttgcatcctgatgattcatcttagggtttccttctagggcccaggagttggcaagctgtgggtcctcctccacaggacagactttcagagacctcaagaggatggccatgctccaccaggaatccgctcttctccacgctgaacagttctttcacatttttctcctctccatccatctagtagtttttttctgcatatgccaggttttacccagcccagttcaagtgtggggcccaaaactgagctcaagtctgtgaatattgtctgatcagaggggagtcattatttccttcattctacactgtacagccaactactgtggcagctagttctgtggtcacattgcactgtaggcccctttggaactttatggttaaccaaacgaggtatttctcttctgagtttcttcagggcctgagttctttaatcagggtcatacaatttatttttaaaacataatgactttttaaatgactctttcagaagtcatcgtgttgagttgggctagggtgttatagctagttccatccttttctccaaaccttggagcattggcaagtttggcacaactgccttatacgcctgtacctgaatcacttctgtaaatgtgagaatgatcaagatcaagatcagagttctgagacatgtcacattagacctgtatgccacgttgaacaccaacttttttttccaacttttattttaagttcaagggtacatgtgcaggatgtgcaggtttgttacataggtaaatgtttgccatggtggtttgccgcacagatcatctcgttacccaggcatttagcccagcttccattagctattcttcctgatgctttccctccccccacccctccccaccctctgacaggcctcagtgtgtgtccatgtgttctcatcattcagctttcacttataagtggcaccacacattatttggttttctgttcctgtgttagtttgctgaggatgatggcctccagctccatccatgtccctgcaaaagacatgatagagtttctttttatggctgcatagtattccatggtgtatatgtaccacattttctttatccagtctattatttatgggcatttcagttgataccatgtctttgctattgcaaatagtgctacaatgaatatacgcatgcatgtatctttataatagaatgatttatattcctttaggtatatacccagtaatggggttactgggtcaaatggtatttctgcctctagatctttgaggaatcaccacactgtcttccacaatggttgaactaatttacactcccaccaacagtgtagaagcattcctttttctccacaacctcaccagtagttgttgttttttgactttttagtaatagctattctgactggtgtgacatggtacctcattgtgggttttattagcatttctctaatgttcagtgatgtttagcttttttacaggtttgttggccacaagtatatcttcttttgagaagtgtctgttcatgacctttgtccactttttaatggttttttttttgttgtaaatttaagttccttatagatgctgtatattagacctttgtcagaaggcaagattgcacaaatgttcttccattctgtaagttatctgtttactctgttgatagtttcttttactatgcagaagctcttttgtttaattagatctcatttgtcaatttttgcttttgttgtgattgcttttggcatctttatcatgaaatctttgcctgtgcctatgtcctgaatggtattgcctaggttttcttctaaggtttttatagtttttggttttatgtttcagtctttaatccatcttgagttgatttttgtatatgatgtaaggaaggggtccagtttcaattttttgcatatggctagccagttctcccagcaacatttattaaatatggaatcctttccccattgcttgtttttgtcaggtttattgaagatcagatagttttaagtgtgcagtcttatttctgggttctctattctgtttcattggtctttatgtgtgttcttgtaccagtaccatgctgttttggttactatagccctgtagtatagtttgagtcaggcagcatgatgcctccagatttgttcttttggcttagaattgccttggctatttgggcttttttgggttccatatgaattttaaaatagatttttcctaattctgtgaagagtgtcaatagttgtttaataaatctataaattactttgggcagtgtggccattttaacgatattgatcttcctatccatgagcatggaatgtttttccatttgtttgtgtcatctctgatttctctgagcagtcgtttgtagttctccttgaaaaggtccttcatttcccttgttgactgtatattttattcttcttgtgacaattgtgaatgggagttcatttgtgatttggctctctgcttgcctgttgttggtgtataggaatgctagcgatttttgcacattgattttacatcctgagactttgctgaagttgcttatcagcttaagaagcttttggaatgagacgatggggttttctagatataggatcatgtcatctgcaaacaaagatagtttggcttcctcgctttccatttgaatgccctttatttctttcttttgcctgatttccctggccaaaacttccatactgtatcgaataggggtgatgagagagggcaaacttgtcttgggctggttttcaaggggaatgcttccagctcttgcccattcagtatgatgttggctgtgggtttgtcatatatgggtcttattattttgaggtatgctccttcaatatgtggtttattgagggttttaacatgaagggatgttgaattttattgaaggccttttcttcatctattgagataatcatgtgtttttttctttagttctgcttatgtgactaatcacatttattgatctgtgtatgttgaacaagccttggatcccggggatgaagcctacttgatcatggtggataagctttttgatggaacaccaagttttaatgtacaccattttgctatagctgctcagatagtcgtgagtccacccagtggtacaaccattcaactcatatttctgaggaagtcatgatagacttgtgtgggtggttaccaattagggattttgaaaacaccaggactttgagaatgatgcaaacggaaggcctcttagtaattaattacctgtccttttgttagacagggaaatcggaagcccagagaaaggaagagagtgcctagagccaccagtgtagtagaacagaatgaagctctagttccatacaatccagatctagccctctgcaccttgctgcagactctattcacaagaggacaatggacactggcacaattatccagaatatatgaagcttccttctaattgacattgaaaataaaaacaagagacatgtcataccgcagtcccttttccagtacagcagtaagaagccagaaagcatccttctctctgaatgtcacccatggttaccacatctgtggccctgaggacacaggctggggtgaaatacacaatgaatggagttaagggctggtgatgggatctacgtggaacccccagctgccttgactggggctagaccatgggcaggttgaggaaaaactctcaacagggtgctgaaaaagccattagttatgttgacctcctttctgagggtgagaagcctctgcacctactttcttgcttgcacagactgggctcaaaaagaagaaaatgtgtggatataaaaactttaccagtaaatttcttaaccagctgacaagcttatttttcacttgtcttcccttggtattttggctcccctcccccccaccccacgtaacttccaaatccagagctcgtatatcctttttcactggaaggaagaagtcatttatcagaagctgagcaagccagcccaccagctccacacatccatgcttctgactgtgcctctcagcctttctcatgggcagcatctctctctggctcctaggctttcagggtctctgcctgtgtctccctagatctccatgtctctgtgcctctgtcttttctaattaccatggttgtctttctctctctctggcttgctctctgtgtctcttagtttctgtgtctctctatctcacttcgtttatccctctgtctctctctctcaacacacacacacacacacacacacacacacacacacactgtttcttttcactctggcctcaggtccatctttcaagccctaaactctggagcttacagtgattctaacccctcccagaaggcccaacagttttcctccaaacctgtagctctgaccttttccccagttatctaactttaagtaatgactgttatttgaacacctggtgtggagaacttagtgtaagcttttcttggagcccacaaaaagtgctccaagtcttcagaaaatgtagaacaggaaaggagaaccactgggactccctggggcttgtcctagcatgagaaaacgcaacctgagcatttgaaggtggcttatttgaaagtgaagcatttgaaagatacctgaggccagatgaagatggcagagcagcagaatggtggctcacacctataatcccagcactttggggagccaaagcaggaggattgcctgaagccaaaagttcaagaccagtctaagcaccacagcaagaccccatctctacaaaaaaaaaaaaaaaaaaaaagtatttttttaaaattagatgggtgtgatggcacctacctgtagtcccagctactcagaaggctgaggcaggaggattgctttaactcaagagttggaggctgcagtgagctacgatcacaccaccgcactcaagcctgggagacagagtgagaccttgtcgcattaaaaaagtaaataaataaatttttaaaaggcagtcttcacttctggccagtgttccccaaagtagaaccgtttcaagctttccgttgccctccagacaaagatgaggctccaggctacagacccccacactgtcaccccagcctcacctctcaccacagaaaccttctttcctgctatgccagaatcctcagcagtgtctccacctgccctctatgtatatgcctttgtgcctttgctcatgtagtttttactcctgaaatctgtttttctccgtttataccactcaggcgccaagtgcctataatttttgttttaaatatctgcttatatcctaagcccaatttgaatgttatttccatgatccagccatttaacaactatttattgagcatctgctatgtaccaaatattcttctagctaccggaaggacggttttgaacaaggcagataaaatccctgccctcatggagcttttggctttagtgaaagacaacgatattaatcagagaagcacaccaataaaggaatattggcatctgagctaagagctttgatgcaatgaaagcatgcaatggagaacctgacctggtctgggaggtcaggaaattctttcttgcagaggtggtgtgtgaaatgagacataaatgggaaggattaattggggttaagccaaacagatcaatatgtgcaaataccttgcagtaggtgcgtatgtgtttgaggaatagcaagggagttggtatagccagaacatagtggaggacagggaaagaggcagaacatcagatcagaaggtacacaggaattggaggccagggccaggggaagagtttgcattttattcatcatgagatggaaaattactgaaaagttctaagcaggagttacaatctttgtagagatccccttggcagctgtgcaggggacagactttgaggaggggccaagaacagtggtggagagactatataggaggctgtcacagtcatccaggtgagagatggtggtggctgggatcatagtgatggcagggaggatggagaaaaaagatttttaagaattagagttgacacaatttaaaaatatattgggaagtggaaggggtgtggacgtagagaaatttatatagtgcagaatacagggaaggaggaacatctcggagaagatcttgagtttagttttaaagcaatttgaatggaacattataatattagttaacaggtcttcagtgctgtagagagcatacggtattacaggaccccgtctctgcattttacatgtgttacctcactcctcctccaaccctatcaagtagaggatgctgctgctgctgctgctgctgctgctgctgctgctgatgatgatgatgatgatgatgattttaatttataagtgaggtaactgagttccagagagataaagtaatttgcctgagatatcacagctaatcagtgaagaagcaagtatttcaattcaggcagtagggcccattagtctagactctttaagcactacattcggctgcctctcatattgagtttgaggttctaccacaggcagtaggtgacagtagctatgagtctggtgctcagaggagaggtctgtgctagagcgggctgctcagcaatcacaggtgcagaggtcattactaaagctgtgcaaggtgggtgaactgacctaagaggtcacccatgacactttattatctgcttcctgtcctttttacatccattaatccaacagtcattcagaaagatcactcctcgcaaagccctggctaggcactggggctacagacatgaaggcaaccaggtctctcccctcagcaagctcacagactattggagaagacagcagagctcacagacagcaagagcagtgctagttgggtgacagccctgggtgctggtgtggagttaaggtgtgggctcaggagatatagatataggtttagatactggtactctttctctggtgacaccctgtagatagatagatatgagacaagagagagagatagatacataaatgaacacataggtaaataattacatagacatataaatagatttgttgcaaagaattggctcaatcaattgtggagctggccaggcaagtccaaaatccataggacaggttgtcaggaaggacaggctggaacccctcaggcagaagctgatgctgcagtccacaggcagaactttttctttctcatggaaacctcagttttgcactaaaggcctttcaactgattgactgaggcctacccagattgtctaggataatgtcccttacttaaagtcaattgattgtagatgttaagcacagctacaaagtactctcacaacaacatgtagattagtgtttaattgaatacttggggactatagctagccaagtgggcacataagactgatcattgatcacaggcacccaggataggaatattaaagagctttcattcaacaaatattgagtgggtaccaggcactgagtataccatagtaaacaagccatataataatccctgtgctcatgtagctaacaatccagcctggtcaatgcttcagcgattttgtcctattaggaattttttccttcttgttcctcactggactgtgagttccatgcatctccagagttgggaccatgtgtgactctttgctgatctccctctcccagggctcagcacaggaacctgcagttagaagatgctaagaaagtgttgctgcaatgaatggcagtgtttgcggccatgagagaaaactgcctggcttcaagcagctcagtcctactaggcatctgaattatagaactttcaagggggacaagacctcagcaatcactgtggtacattccattcctttaattttaaatgccccatttcccttagcaccacctttccttagcctgctctgggagcttttgtgcagctgttactctgtagtcagacccactcaaaagtacagcccatcgagtgtagtcacggaagttgggtctctgctttgagaattacactttggggacaacaagtgacccctttggcccaggccaggtctttgctaaatcaatgcatgctttgtttagcgtgtatggggcagaatgggaaggcctggcccactaaatgaaaaagactgggccgggcgcggtggctcccgcctgtcatcccagcactttgggaggccaaggtgggtggatcacctgacgtcaggagttcaaggacagcctggccaacatggagaaaccctgtctctactaaaactacaaaaattagctgggtgtggtggtgggtgcctgtaatcccaactactcaggaggctgaggcaggagaatcgcttgaaccagggaggcggagactgcagttagctgagatcaccccactgcacaccagcctgggtgacagagtgagactccgtcaaaaaaaagaaagaaggaaggaaagaaagaaagaaagaaagaaagaaagaaagaaagaaagaaagaaagaaagaaagaaagaaagaaagaaagaaagaaagaaagaaagaaagagggagggaaaggagaaaaagaaagaaagaaataaagaaggaaagaaagaaagaaagaaagaaagaaagaaagaaagaaagaaagaaagagggagggaaaggagaaaaagaaagaaataaagaaagaaagaaagaaagaaagaaaggaagaaagaaagaaagaaaaggaaggagggagggagagaaaaaggagaaaaagaaagaaagagagaaagagagagaaagagagaaaaagaaggaaaagaaaaagactgtacatgcatcatagctccattggtctttggattctgtgaggaaattgcataagttgccaccttcacagacagcaggaaactggggagctaagacaatcacagggcaaaatgagctcttagttggtgaagcaggcctaagggcctggccccacatggagtctcacatgctggaatagaggcaggacagccttttctgaccaggagcagcacggagacaaagaacttccaggctggagatgacctctagagggagggtcatttaacacaagctacacggagtgtggttcacagtctggtgctggttggcaagcagtttgttccaggtgcaagacaagataaatgcagcaattagagtaggtatttaggtactgttttggcaatttgacatggctgcaatgcagaagtgtgtgattttgtattttccaaaagtatagattgtgacagaatgaaaattgaaaaacgagtccttccttcacaagaagtttaagaagaactgctctaaagtacaggcttcccagcctagcagtgagtcaccagcatagaggttggcaactgtgtttttgttgttgttttttgagacggagtctcgctctgtcgcccaggctggagtgcagtggggcgatctcggctcactgcaagctccgcctcctgagttcacgccattctcctgcctcagcctcctgagtagctgagactacaggtgcccgccaccacagccagctaattttttgtatttttagtggagacggggtttcaccgtgttagctaggatggtctcgatctcctgactttgtgatctgcccgcctcggcctcccaaagtgctgggattacaggcgcgagccaccgcgcccggccggcatctgtgtttttaactccctcccacggtaactcccaagcaggcttgggaaccagtggaccattggtatgcaatgacctgcaccacaaacaggagacacgtgtgcaggagacaccttcatacctggtttcagtggtcatgaaaccattccttgcacacctccagggctgaggggtgcccacatcctaaggcagtggctctgacctcaaaaaagtgcttacttagctggagctggagtgctgagtggcaactgggcccctctgagaccccaccagggcagggtctgtggacccatgttcccgctcctcaggcagaggctatttagactcccagcctgtctgtgagacatctgaaaaaaccttgctgtgtgcatcaccccttctcatagaggctcctgacagaggtacacccatgccatctctgacttcctaagtgcagttactggtgccattctttccctttctaccagcaccccccaactcttgccagaaggagaatagaaggacttgatttgttgagacccattcaactgcttctatattcacccctgtgacgtccccatctcacttgaggctgctcccacctgcttagcagggcctgggcctcctggacttcccttgctttgaccatggcctcccaactctgcttgacaacctgccttgaaaatgccagttggcctcagcttttgccttttcaaagctatttggccacatggttcctctaccttgttcatctgggtggggagtgggcaatgcaagtactagtgctttggaggatgagctgtcaactttcttagaacaatgtgtgctagcatagtgtggtgacaagagccaaggacagagactcagggaacatgggctcaaataccacctctgttactaaatcattgtgcatctctgagaatccctctctctctgagcctctagatcctcatccataaaattaacatgccttcctcagaggcctcttgtcagtcttgaaatgaagcataggacctgaaaggaatttgtaatggctaaggcactagctctcctgaagtagtagctctctctgctccagaccccagagaaaggagggttgccaactcagtgccaatgccgtgcatttttatatgtaaggattaagaaaataagaggatattgaaataataaaggccttgcaacatctaagttgatttgtatagacaaagagcaaagaggaagacttgtcccactagatattgagacctaatacaaatctatagtcatttagtaaatagtaataggttttcgtacaggaaaaaataaaaacagaccccaaaggaaaacactagaaagttaatatatatgttaaattagaaccacaaatcaatggagaaatggagggtttttgagtaaacagtgctaagaaaagtggctagattcccacctcacaccatacttaaacactgattttcgatggatttagaacctaaatatacaggtaaaaacataaaataaattgcaagaaaatgtaagagaatacctttttggccttggagtggaaaagggtcagatctaaaactaaaatccagcaagccgtaaggattgatagattggaccaaacaaaattacagattgctgtttacaaaatgacatttaaaaacaaagataaactacagagatgaatagttttgtgatgtttaaaaccaacaaaaaggaattgatcaacaagaacatggaagtctgaatttaaaaaacagagaaatattttgaacaggcaatttacataaaaggaaatctaatggccaataaacctgtgaaaagatacccaaactcagtagtaatcaaggaaatgcaaactaaaaaaataagattcaccttgccctatcagtttgacaggcattagaaagctgggtaataatagtattattatttgtcaggaaggacaaggtgacactgaatcccagtgctctcctggtagggagtgcaaactactctactgtactggagagcaatctagcagggcttagaatgaagcatacgtgtattctctgatctagtgagcccacatctggggctctaccccaacgcaggtcccactggggacgtgtccaagggtggccactgtggcactgaatggaactggggacaggttatcttttcatccccaggagaatggatgggctaaatacaaaactaagcagcagtttgaagtaactagatgcatgcacaacatgggctgatctcaaaattacaggctgatttcttttttttaagtaagaaacagaacaagatttatagcacaataatatttatgcaaattaaaaacacatacacgaaacaacactatattttataagaacgcaaacatattcagggactcatctcaaatgcattaaagtgggtgctcacggagggggaaagggatgcggggacctgagagaatgaggaggaaataaataaaatgcaagagagaccttccacataccgtaggtgatgctagtggcccagccctgaagcgaggggcagattcaattcaactctctgcacccgaggtccacaaatacattttaataatacaggctttaaaggaaaataggggcaacaataacagagagtggctgcttaatgggtacggggtttccatttgagtgacaatctgctcatccccagcctgtctctgggctactggccctttgaggccaggttccccactgcagcacaaggaccccttggcatagatggcagtgctcagggctgagggcaggaggcctggcttccagccccagctctgcccaccccgccctggggagctagtcctggtcctgtttacctcacagactcattgtgacgatcgagtgggctgacgtatgggaaagagctcagtgcctgaaaaagcacagtgtggtgtgagggattattggtgatatttatgaccaagctgtattgctcacgaggcaattttgtctcccttattccttcctgacatggcagccaatctccatttcagtgacttgggtcagtgtcaattaaaacaactgagagccctgcagggcagagggttggcaggggcgggagttcagagcccatcactcaggcacaggatggctactcaagatttacttcatcccagagccccacacacatgtgtggaggctcgtgtccatgcacccaccacaccacatgccctggggccttgatccttactcggcacggaaatgtcttcagagggtctagctccggcaagggtgggacacttccaggctgcatgacaagcttatgggaggcatcggacattttctttctttggaagaagtgccagcagctttctttccttggaggccccttcattacctagttggtgccactcagtcttggtatgcttaaaaaggcagtcctccccaaggtcttggtgtccaagtccagcacctttgctcagggtttatgatccaggctgaagctggtatttctttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgtgttagccgggatggtctcgatctcctgacctcgtgatccgcccgcctcggcctcccaaagtgctgggattacaggcgtgagccaccgcgcccggcctgaagctggtatttctaacatttcctctacaagccaggtcatcccacacagtctatgtgtgccttcctgtctaatggagcccttgacatggactcctgtcttagcgggaaacctgtttacctctcccctcctctcatactgtttccttttctagaaatgtcctgtcctggttctctgcctgaaaaacgactcaaccttcaatatcttccctaattctcccagacagagacagttacaatgtgccctagacttggcagcaccttttataagtctggctctcacagtacacagcatagagcacaggaccccagtgatctgtgaccaggtctgtctttccactatgttggaaatcctggagggcaagaagttggtggaattgtcatcggtgtccccatcacccagcgcagaatgaccaaacactttgctggtgctgggttcttgtcactatttgccactggggcatcattcacacaataaactttcactgatttcttgctgggtgccaagcacagtgccaggccttgggggtacaaccagacacaagataaacatgatctgacactattcagtggagagagagaggagaatttgaacaatcacagaaataaaggaggacaatatgagtgagtggtgctagccagagatttaacaaaaggtgatgtggcagagagtagctgcatggacacttcagactgggcgaccagacattcaggtggatgattgagtgtccagaaggagacagtaatgcagagatcaggggacagagcatccaggcagtgggaacagcaagtgattaaccgaaagttaagagcctctgctatcactgaaacaatgattaaacacatgttatcttgggtgaaggctccctactccccagcttgtagcagggacagaaggaaaacagctccagccatctcccttgagcagctttgtcccagtctaatttgcctttccactggtcaaactgctgctgcctgacaagagccctgagtcccagatccctggaccaactccgtcagaaattgccttgatgcacaggataagtgaggtctggagccaagcagacccatgttccaatcccagatctttcacttactgggactctagggcccattagttaagctccctgtaccttggctgttgtatgtacaaatggagaaatctagcttgttgacttaatgccaggcttaaaggaaaccacacacgtatagtgtctggagcaaaatgggcctgtggtgggccaaaatcaccacagctagaaaacccttggagaccatttagtccagtcttctgttgaaaatggggacactgtggcctagtcttgcccaatatcacttccattcaggactccaacataaatctcccggagctcgtacttccctgaatattaaattcgtctttcagaaatagcacaaattcactttccacttgtatcacaaggttgaagagtggctgtgggtgtaggggtgtgtgggcatgggtgtgaaacatgctaagaaaatcacttaacacacaaacacacatgtgtccccacatctctgatacatgtgtgcagactccacaggcgaagaatctcgctctgttattcctaactttgacttctgatcccagttctttaactttctgaatgtagggctcagagtccccagctgtataatgggacacttaagacaatgtttgtgcagccaccaccatgtccactcccttgagactctgcgagtccccagaaagccattgccagcatcctctagcaggttttggtgcaatggcagaaatgatgatctgtgtgtaacatctctaggagctgccctggcctgggaatatgactggggagggttggtggcttttctgggtccaatgccttcagctcagtgcaaagtctgtcgaggctatatccttctactaccttcctttctcccgcttcatgtaccactggatccagaggctggtcccaggagtctgctgcttgggatgctgggagctgggaggaagaagggtgggctagaagcctgaaacatagggaggagacagactgagaaggaaagggaagagaaggggcttggaggataagctggagcaagaactgtgagaagggaagagggatgatgagaggtgaggcagaagcagggactaggctgctggaaaagacagagccatagggaggagagaggcaggcagcaggaaaagatggctgagccatcctgaaagacagagaagaggaggatgggaggattcgggaggacagagaaaaaagtgcctggggaggggacaaagaatgacatgggggaaggaaaaagcgagctttagagggggagataaagcagggaggagaaaaggggaagcaaaagggggagaggagggaagagtggtctcagaggcaaaaggaggaacagaagaaagggcgaggaggagggaaagcagatgagagagccacagagggagaaagaagcaaggaaggaggaggggcaggaggaagaggagcaagagagcaaagagaggagagagaagcacaaaaagaaaggagttggaaggggagcaaagaaaggtaaaggcaaggagtgccactgcagatggcatctgtgacccaattgtgaggggtgaccaaatccaagcctgggaagacccatttcaaaaggaacatgacaatggcctgccgcttgtctctcaagagtccttgtggcatttccccagcagaggggagccagctcatgacctgccaagaccccttccactccaccagtgaccctttcatgccccctccgagtgagccctgccacccagcaaagctgaacaccaagctctgcatgttggcctggcatgagagtcagctaagcttttccacctgtcatcactctgccgccataagttgccaggatagggtcccagatatctccctcactctcttcttttcttcttctcttcctcccttatttcctcccctcctttcttctttcctctttcccttcttcttgccttccttctctccctctctccttcctttcttattcctttctccattcagagctggccacagccttacctcacctccacgcccctcaatcccacaatgggggaggcggaggtctcggcccagccctaggtctaggttgaatccccagagcggaagccaggtagaacccaggagtgtgtatggcagtaatctcaaagctggccactcagtacagtcaccacccctttgagtagcagagaaaagctgcttccaactccaagctgtggctttgtagggccagtaattcaaagtactagtgatttactagtggccctgatctagtgatggtcactggttatgaaaactactcttaaaataatgggcagatattaaccactaaataagattttcatgccattcgaaaacgattcaatacatgacaagatttgaaaatagaaaaatcaagttttagccagctccatctcaaaatcctcaaatgtcaccaatcaggacttactccatctggctatgatgttatctccgcaattgggtaaacaacccaccagaaacctgggtttccggcccacagtggctcagtctggggatgctatcactttgaggttcaggagcaactttgggttggcatgaccacagcagccggtgttttgaaccgcacactccactcctttctgcacacagtacctgaaactgttccataacaggtacagttagctctcggcacgtttacgcacagtcactgcctcgcctgccttgtctttgagccaaggaaaactgttttctgttccacatggtcagagcagaaaaggaagaacaagaccgtgcctgtaaaatgagatgctggcagagttcctgtttctcagattctttactcccccacctagccctcagtccacatctgcacaaaactggtctattctctgaaacgtctgctatgctatggacacaccggacacaacattgtttcctaaagggctgtatttttatttcataggcataatagaaaacagcaagcacctgaaaaaaatcaagaaatacactggttttcccattcttttaaaaatatttgttggcatctactctgggtcaggcactggacagagacaatgcaatcaagcaacaagaggtgacttgattgaatggggctggggagatctctagagaccccccagatcagggtggctttagaaaagaagtctgtttcaccttgaaacctgagggacccagtgcttacaaaagagagagaaaaggggagagacatgagctaaggcttccgggcctggcctgaggaagcaatgctcctgggccactggtagtacacccaaattgttgcactggttttgaggcggggcttcaactcagcctctctaagcacattgcatatccaagtgctcagcaattaaatcgatccacagaggtgactcacaggcagccagccagcacagtcacggagccctgtctgcattaccaatttgcctgctcaagttgctgccttgttaatgttatttaccaagcccgatgccctgaatacctgtccctagcccctgctggagccctccagccattgtccctgttcgcctgtcacatcttgtcactacctccctgaattcaacaggtttgggcagcctgtctgcagacctgcctcctcactcttgtatctccaggagccaggaaggtggcctagcagtcccagccttaccctctctcagaacaggtcccagaggtgaatggcctacagctcaaccctcctccctttctttgggcaagagatggaatgggttgccgacaaaaaccctgcagggtggcaccgtgtagttggcaaatgtggccattgagaggagagggtgagggcaaaggctccaagggggatgtggagatgaggagatctgaggcaggcgctgaagagcttcctcctgccatgccctgtgcctgcagctgccctgctcaaattctttcttcgccagagggtcttggggcgctcccactcctggagtacaggtcgtgcaaaaaagctcccgctacgtggagattgagcaagggcttggcaagcccaacggtgcgctcgaatcgcggtgcaagagcgtccccaccattctttacggccggaggtggaacagcagcagggcgagctgtctggagcccgaggcagccttagcttggtcagccaggcgctgtccagacctggcccaggctgctgccccacccaggcctcttgcccagcccacttcagtcggccttccaagactcggatcccgaaagctgtgccccctccagcaccaggcaaacaagctatatcttggtggagcagattccaccttcacagagccagagtgcaacagaatgccagaacagaagggtctccagagaccttacccgttatatagataacaaaacagaggctacgggttcaaggaagtgccttgtccacaggcaaccctgggaactcctgattattatctcaccactgttcccatccagcttcagtcctgagcccctgtgaccatccaccttgcctttctagaccaacaaagagagtgggtctatgccccagggactcagaccctcaagagccagagacccacgcctacggttccctaggatgcctacacctccagctggcctctgattccaccactccaggaagaagttggaggcacttggatatggcacaaacccaggttatgaaacccagttggcacttaaatgacctaacaacaaattgcccaatttaatttgcttacccgattcaataaaggagaaacaagaaacccaatctaattaaaaacattgatccgtagaaactggcaactccaaagtcctggctggaagtttgagcttagacaaacttgaatgatgcaagtgtacaagctgaggtaagacgaatctatcctctgactccccaggagggctgcaaacggcctgcgaacttcctttcttaaaataagtgggaaactgaacccaaaagggaaagaaatttgttcagttcaccactgagatcactttaactccaggatctgtagagcccaggagagagttaggttcatgctccactgaaccccctcctggccacagactgaggccattggtcttgctcttcaacactcttgctcacttggcttgtgggacctggcatctcatcctgcttgcccatcgagctcctctgcatctttcaagaccctgggcaaatatcacgttccagggacaaatctgtccaaagaagacaagacagaagcttgctgaggcccccttagcactgcccagtttgagtcatgtgaatatgcagttaggctggcagtgctgggaaagagcagggtcttcctcaagcctagggaagccaaggaaagaggctctattggatactgtcctcttccccagctaccctactgtgctatgttccagatttccaggaatagaatagtccaagtccccagaaaatgggagtggaacaggaccaagcttaggttacagggctcccaggccagtgttcctacgggccctctctaagcgtggccttggtcccagccacagcattgagtcccttttggacctgggcttagcaaacattttatctagaaaggcatcttcatcaccctccccgtcaggctaactgtaactggcttggtttcaggtcctaaatcagggctagattgtccttccagggaaatgtctgcctcagagagaagcaaaatcacttagttcttggcagctcagtctctgccagggggaagttgacctgccactgaacccacagccagtatggcacaccactcctcctgctggggccagctggtaccccatgcctgcctaccccagctccctgttcaactggggagctctacctcagcagagctccctggggaccaagtccacacccactctcctcctccacacacataccctcttgcaagtagctttggctataggagggtagcatgaatctcacacagccccatcctccaggagcaaggaagggggaaagccacaaatacagatgatagctgagtcacacttgtttataggggatcaaagaaggctttgggagggaggtgacattagaggtgactttgaaggattagaggaatgttgcagacagatgtagggatagaagtaggtgtaagccgagtttctcgtgggacagctccagttgggttacggaataccaaggagttttgtgtgagcaaaacctgcagggctatgaggatgggcagagagaagcagctaaggatatggggtttagtccattagagaaaaaagaggaggccagcccctaagaagttcccagtattgggcatgtacagaacactgaggtaccagtagctgctctaggtgctacagatgtagtgggggccagcacaaaggtctatctcagggagctgacattctaattggggaaacaagcaataaacaaggaaaccaatgaacaagaagattgtggagggtgctaagtgctgttaggaaaacctcacagggtgccgagatcagcatgactgggaggctgggggctcttttcattgtggagtcctgaggacaagaagccagtcacagaagttccagaggaaaagagagcaacacataaagacagcaagcgcaaggctgccaagggacagagaagctgggtgtgtctgaggaactcagaggagactggaggacctgactccagaagaggccaggagagaaagcaggtgaggccaaggatgctggcgggcgctgtgcaacaggacctggagaccaagccatgagtttgaattttattataagagtaatggaagaccccaaaagaatgtaagcagaatgagacatgactttcattgcttttgactactctgctggctagatggagagtgggttggaggggagggagcaaaggtggaaacagggacaccagtctggaggcgactgcagtcatccaggagagagccctgcacgagggcgggagtggcggaggtgggagaggtgcatggattctaactggactttgaaaagttatgcagacagggtattttctggctgattggatgcagtggatgaagaaaagagaaggatccaggattacatcaggagctttggcctgagcaacctgaaggacagacgtgccatgaccaacatgggaagatgagcaggttctctaggaaacaccaaagggtgagttatggtggtgttacttttcaaataccatggtggcatcaagtaggtatttggctaaatgtacacaatcatctgtgtactaccttcatgtgacactggaacaattatttatataataattttatttatgtcaattttaagtaggctgacattagctccatgctaaccaatcttatccataacatcaagggttttttagacttctagtatttttttttttttctgaatacaataagtaatgacaaccatagtgctcaagtctccctgtaattccaccctgacattctctccttccccagtctccagcagagtctgggtacctagcatgaagaaacttgtactgggcattggccttgacacccaggaacctctgagggccttcaaagggaccacagtggggcacaatgggaaagagaccttgtccaatagctctgcaaggccccggggggcagccacctaactgcctcaaccggccctgctcagtcctctgctgggtggagggttcgcagagtggagcccaccaccctttcctgaggttcatgcgccctctggtggtagggttccccatctctgtgcactgggggcttccttgtttccaggctaaacagaagacagagaccctctgcctcggattcaccgaagggaggggataaatggtcagactaactttaagctccagaccaaggaatagatgcttctgaggcttggactcaggctgggctggccaggcaaggaccaccacaggtcacaccaaaagaagaaggagtgtggtgcgcaggagaggggacttttgttttgtatagaaggtcaccaatgcagagaaaagcaattgatggccatatgcaaatagagcaatttaccttcaatgggtattttcaaatgaaaataaaaaacattccaatttaaacattttaaaatcaagagcaggaaacatcaggctgtgctgaataaatccaacacataatggaaaacgtacttcagttcctatattacagccagttataggagagaggcgggggcggcggccagcaacagacaggagagtcacgctcttacagagaaaacaaccggagagagggtgggtgaggggctggccagagacagacactgcctaggctgacatccagatcctcacacaggcacacgcgcacaaacacacacacacacacacacacacacacacacacacacgacaagctgcacagatattccttctgttgttccttcatccttttctcaatgaacaaactgtctttagatgagaatatattattgctaaacagacacttgcagaccagtgtgcaagggagtctcacatagaaagctgtggcaggactcggagaaggggcctgtgaatttcatctcagaagaaaaagtggcagaaaagggtaatccaggcagagggaacagcatgagaaaatacctgaaagcattccaagacctgaacactaacttctcaaaaaggaagttttcatcacctctaaaaatgaattcaatgtaattttattaagagcaggaaatctagaccttcctctaatgacaatccaatagtccaccctcgctgttgtcaaaaaaaaaaaaaagttcaaccccaaaattaacagtaattagcctgagatattgtaaatgtggctctatagtctgaaatttaatggcatcttttgtcaaaaatagtcttttttccactttagtctcatgactacaatactatagtgctatccctatagtatttactacagtacagtcatcaaaaatatctgaaaaaaactcttagaccttgtgaaatagtgcatccatccacttctataaaattaggagccacgcaaagatctaacagagtgctgcttgcccagatccagaacagagaaagttagtgttaaggacttggaatgtgaacacattgtttgtagtgctatccattcctctcctgagattttcacttactactggaaatccttaaccaattataatagcttttctctctttattttcaaaatgacttcctttgctttgcttagacactctgtgctctcttttttttggggggtggggggagcgggtaaccatagttcatctaaatgcagctttttctgaaccttaaagatagaatcccgtttttaatgaactgaagtagcaaaatcacctttttcattattttgggaaatagctattgccaaagtgaaggtgtagataatgcctagtcttgttacataatggggatgtggtttgcagaattttctttataaaattgtagtttcaagggatgtcagtgtttatgccacttttccagttccaaaatgattccattccattgtagaaatttgaagtatgtaacttgaaatccttaataaaatttggatttaattttatttaaaaaataaaagaaaatacctgaaagctgaagagaacatagacattcgagacatggcaaaaagttatgagagagtgggcccaaggatatctggggaaaagaaaactggaagagggtgggagctgagccctggagtctgtgtcttgaaccaatgagctccccatgtggtccagagaaggtgcctgccttgccctggggaaaaccaaatccaagacacaatgtccatcccatgatgtgggctggaaatcaggcacctgttggggctgggctgatggtgaaccaggctccagggagaacactgaagatttcttgctgaaatcaaggcaaaaaatttcaatgcagtcatccccctgtttctggccccagtaccatcttacgcctgcaaaaattacattttgtcctggttccaagacacggtaaaaactgaactcagtgcaaccttagcaatgaggttattggcaaggagctggctaggtctccgaagactcctcctgttgcgtggggttctcttgaggcaaaggggtttagagctttttctccaagcccaatacccaaaggggggtgtacacaaagcactgctccatcatgaatgcatctctctccttctgcaactttcagggaccaggacctaggcatgtgtcatgttacagatccgtccaggtgagtcttcccctggttaaggtttcttcctctaagctagggaagaggtcaagaaactacactaaatgtaaaagaagcctggccagaaggatgaatccacataaaaaggaatggtaatgccaaaagcacaggcaacagaagcaaaagcagatgaattgaattacaacaaaattaaacacttctgcataccaaggggcacaatccacatggtcacaccgtagaaaagcaacgtagacagtaaggaaaatagttacaaatcatagctgataagggtttaatatccagaatatataaagaacttctacaacttgacactccaattaaaaaatagccaaagaacttgaatagacatttctccaaaaaagatatacaaacggccaataagcttgtgaaaatatgctcaaaatcaccactcattagagaaatgaaaatcaaagcaacagtaagattcacctgacacccattaggatagctacaaaaaacacagaaactaagtgatggggagaatgtagagaaattggaacccttgtgcattgctggtaggaatgtaaaatgatgtcactgttttggtgacacacagaaaagaaaatggttcttcaaacaattaaaaatagaattactaagtgatccagcaatttcatttctgagtatatgcccaaaaaactgaaaacggggtctcaaagagctatttgtatactcatggatacaggaatattcaccatagtcaaatggtggaaacgacccaggtgttcatcaagaaatgaatgactaagcaaaatgtggtgatctatacaatcaaatattatctggccttaaaaaggaaagaaattctgacacatgctacaacatggattagtcttgaggatgttatgctgagtaaaataagccagacacaaaggacaaatactgtatgatagcacttatatgaggtccctagagaagttaaatttatagagacagaaagtagaatggttgcttccaggggctgggtagaaggagcaatggggaatttttactggggacaaagtttcagttttgcaaggtgaaaaattctcaagattgttttcacaaaaatgtgaatatacttaacactactgaactgtacacttacaagtgattacgatggtaaattttgtgtgtatttcaccacaagaaatacatgaataaataagtggtgtgcatgtgaacaggaaggcctctgagtctgcacctggattttcttgcccactaattagtacttttcctttaggctcctgatcgtgttagaatgcccagctgaaagacctgatactccaggagatctttcccaactcccccagcagagccaatgcttctgtcaaggcatgactgctgtcagggagaagcatgagagttttggtccgctgtgtttctttgctcattcatccattcattcactcattcatgtgttcacttactcccccaatgaataaatgttctctgaatgctcctcagtgccagctatgtcactgaggctccaaatagacacatgaggtagactgtcttggccttgtccacagtcaggaggggaaaccaagtccactaaaactgaccgcacattacaaaaccaggacagagaggctctgcgctgtgggagcctacagaggagataattgactagtgtgggagtggttgcagtcaagtgggccttctgcgagaacgtggtgcctgaggtaagccctgaaggacccataaggcttaggcaggcagggagaggtgggagagtgtatttcagaccgaaagagttctggataggggcaaagaaaagtagtctttccttcatatccttgcgtttcacatctgcaggttcaaccaatggcagattaaaaatatgcaggaaaaaaataacagatcaaaataatacaaagaaaagatacaatataacagctatttacatagcactgacattgtattaggtgttacaaataatcgagagatgacttaaagtatgggaggatgtgcataggttatattcaaatacgacgtcattttgtatcagggacttgaacatccacaaattttggtatccatggggactcctgaaagcaatccctgatgaatactgagggacaaccatatggtgaaaagagagggattaatgaagggagggagagaatgtgaacagcagagttgagcaataaccacagatagttcaaaggaattttttaactcataggtgcctctaatgcagatattaacttgaagagtctccccaccaccagcagttttcagggcctctttaggaatgctcttcataggggagggatggccagagctgccagctacctctgtctccaggtggacaaatgccagttgccttgctcctcactccctgccctggaatggaccagaagccgggtctatctccttggtccacagaagactgcagagatcccatcctggctagcagacagacagatcaatctacagagcaggagctggagcatctgatgggggaggaataaccctgagtgggcacccttctaccccctcccaacaacactatcacatcccttggcctgtcgtgggagacagacactgggtacctgatctaaatgtctatagtcggtgctcgaagtacatgcgtgtgcagggaaaaaggaagcattcagaagacatgttagaaaaagcgggggccagaaccaagggaggggtcgctatgagcaaaagagccagactcctggcagacagctgcccccttctcccttcctcagacttaggcaggccgaagctctcggaagcccagccaacgcagtctgtactctccacaaacttgggctaaacttggaggcggaatcttggatgtttaggccaaaaacccagggtcagagaggcttttgggagaattcagggaacatgagggtaatgcatgtaaatccggagatctaaatagctcctctagcttctgggatcaaggccaaggccaatgctggagaggcagttgggccccaggtcttatggctcgtcagcagcagccagctcagggctgttcatcccatcagacaggtagtcatcttcattgttctgtttcatcttggtttccagaactgtgatgcgctgcttgagcttctgctgggcccccgtgtactcagccagcaggcggccaaagcgagtgtacaaggtttccatgttggtctccagctgccctagcttctcctgcacgtcgacctccatgctggttgccacttcgttctcatccagcagtccctccttcatgaggatctcccgacccctctcttctaggactttcttggcatcagggtactcagtcacagcttccataagatcatccttggacaagcagaagagatctgagtagcccaggctgcggatattagctgtgcgtcgattgcccattttactgcccttaatgttaaggatactgatctcgccaaagcagcttccagccgacagcagagcatactgagtcacaccatcatcagccaccactgccagtttgccctccttaatgatgtacatctccttgccgatgtcccctttgcggcaaatgtaatccccaggactgaagacctgaggacggagtttcagtaccagctctaccagcaggccagcctcacaatcatggaagatgcgcactttcttgagtgtggacaagtggacattgatggctatctcagccctgagcttggctggcagattcttgagaatttctcgctcatccactgtcttcttattggtccacaagtagtcaaaccacctaatgaccttggcttccatccccttgctgacctttcggaactgcatgtagtgtttcacggcatcgatcttagcctggaactctgcccgggtggcattcatgttggagatcatggagcccacatttcccacgatggtggcaaagatgaggacgccaatcaggaagtcaaagatgacaaataggtactcctcatcctttacagggggtggtgtctccccaatggtagtgagagtcagtgtggaccagtaaaggcaatagatgtattccctagccaggtagccatactcagggtcagtgatgtttgggtaaacccaggtgtcgaccccaaagcctatggatttggagatggcataatagatgcaggcattccagtggatgatgaccaagatgtagaggacaaggttgctgatgcggaagatgttagggtagttggtgcgtgtctctgtccggtcaaagaactcaaacatgcgggcaaagtgcagcaggcggttgaagcgcacctcagggctgtggatgtccacagcaaaatagatcaggtcagtggggatgatggaagccacatccagcttgaactgcagggtgtggatgtagttgtctcgcagtttcttggtatctttgaccagcagcccctgctccaggaaacctagtagagatgaaagccagcatgtcatctctgccctcagggtatatatatacatatatatgtgcatatatatacatatatatgtgtatatatatatacacatatatatgtatatatatacatatatatatacatatatatatacatatacatatatatatatatatccttccctataggctaatatctctaggcaaggaaactactgctcactgaaacttccttcccaaggaaggatatagctcacataccagggctggccagaaggactctaagagaacaccccgagatcaaaacctctctatgcatgtgggaccatgaggttcaaagaagggtactcacctaccagagtcccacccaagcaatttagtccaacaccatgtccagtgggcttcctaaaaatttggactcaggccttcggatttacctgcatcccagttgctcactgacctgtgcgcaatcggatgaagaggtccgcaatgtagaccacatctgagacataatccagcaccagccacaccaggtagtagcctttctgtaggtcactgaagcaggctctgcgggaggacagggctaagcttcacccccaaagccagccaaaggtcccttggaggccccaaactgagtgttcactgtgtgcagggcttgggatggctaccaggggcatcatttagtcacagtcagcctgatgccaagagatatttatctacaagtaacttctgccccacccctcctcattacataacatcactacatagacagcaccactaaccattaattttctgtctcaccctctgaactgtgagctccaggaaggcagggacccctcttagtcattacggcatgccccatgcctgacctagggcaacaggatttgagcactcaatggctgtgagttgaatgaatgaacaagtcattggaagaataaactacagcacacaactgaaccatctccatgctcatctcttcaacatacatcttattcagcacccaataaacagcactagccaatacacgtgagagggagaatagtagtgggaatggagaaagtttggaggttgcagaactttttaaaaggaagtggcaggatttggcaactgagtagggagaggactggggagagagcagagtcagggacacagcccaggatgattgtccagtgagtgtactagtcaaaggggagagccgttaagtctgactacttggtcacattcagactcaaactccagccccctccccttcccactgagactgcagagctggcccatgccagtgatggctcactcacagcctccagccacactaggccatcccgagacagggttttcatacttgctgtttcttctgcccagaatgctccctccaccatcctcaagtatctaattggctgcctccctcccacgagctaaggcatcacctcctcagagacgctgatcctgactgccctttctctagccaccaggccctggcatcattctggtcatttgtttcatttcaggtttacagtcactgtccgccactagcctgagagctccaggagagcagagaccatggttgttgtgctcatcacattatccccagcactgagcacacatgaggtgctcagtcaaatccttgctgaatgaatgactgggattgggacggagtaggatggggaatgctgccaaggaaagctacatgtagatagtggcttttgaacttagcctgcaaggagaagaatctccataggtggaaaatggaagggaaagggaattttctctagaggaaacagcatgttctgatccaagagtggtgaatgctggggctggggtgtatccagaaggtgtagcaagagaaaaaggtcaggtccagaggagtttgaaggccatgcttagaccttgaacttcctcctgtggacaatggggagccacttaagggtttgtgaggagggaatggcatcaccaaatcctagtttgctatcaagcatgtttgttgcaaatgtggaggatgcaccctaggtgtgtggaaccactgtagttgtcccagacacaggacagacaagaaatcttcatggcatattaaatggggagagggttggggttaacagagaagttggaggtgccattggtatccagggactgctgcgccgtcaatcccggggtctgaagactgggttgctttggccacccctcctgggccccaccctgctcacctggccaccagcaggcaccagttgtaaaggacgggcatggcaatgacaaatagccagcagtagtaccaatccccagctgggtccaagacaaatagttcaaatttcttcctgagaagacagacaaaggcaaggtttggggatcaggtcccccagtgtgatagcaccccagctcccagaaaccagaagtgcctgagaaagcaaaagcactgccgaagggtatatgtggggtgaaagatgggttggctgagggccacatttttcagggaactacaacctggtactggacatctgagtggaactcagatgggcgggggcacccatcttctcattctgaacctagataggtccattggttcccatgcacgttacaggccccttgcccagagggcatgtcaaggggcagagctttcagtagtggtgggtctcagggcctgggaagggatttccacaggatgataattggggcttaggcctattcccacatccctccctagagagaggtgctccaggtgagtgagcaccatgagcttcctgcccacctcaccctccctttttggtcattggcctccagcctccaaatcacttccccagatgttgtgtcctgctttgacaagggatgttgtgtcctgctttctctccactagccagaggtggggaatgtcagcttggccagacatctgcagttgccttctcattcctcaaaagacaaaccctccagctctgccttctctgccctccccatgctatcctgctccatcattcagcgcttctcctccatccctctacatgatctcttcaaagacccacttccttgcccacagtggagatgagattggcatcccctccagggcactccctgaatgcaccctctcagtatttcctgaccactggaactgggctatacattcatgtgcagcaagaggacatctggcaagaggcaactaaggcgagaaaagacaccagaggttctcatggcaagtaggccactggctgttggggaaacaatggaaatattctggaggtgaaaacattgcaaatcacccttgcccaccactctttttactacagcagggcttgtcatagcccctagcagtagcatagaaaccccagtgagctcttccattgcatgcttaaagcccatttgagtcccataggctgaacagctgtacttggtgcctttgtcctcgccatccttgtcgcctttgccatccccctcctgtgtggtcacagtctggagttcaggcccacgaaaacgctcgaggaatgagtcaggcctaggttcctcctctcggaaattcttgttggcccattctctgatgatccccaccaggcgaactatcctagaggtgagagaaaaagagtatgagccagagccaagactcatgctgttcagaaagcaccagtccccaagagctcactgtctgctaaggaagatgaaagaaggacagtgaaacctacaaacaggccagaccatgatttcccgtgtgctaaaagctggggtagaggccatagggcagggggctggggctcaggcatgaccctgaatgcagtccagggggagactgctgtcctgggaagacttcctataggaagtgccatctcagttgatggtgcgaagagcaagcaggaggtcttcagggaaagttggaggtggtgttaaggcaggaactatcatgagtaaagcttgccctgagcttcctgctttccctatggagcctctgactctgggacagagaggccttgggtcctctacctaggtctctctaccgggaaggatatcgctccctgatgctgagacagccaaatgtgaagggaggcctcttctggcccctctgagcttgcctgccttggggtttgcccagacctcaggaggacggaattaaatttggctaccagtgacagtgctccttggaggtcttggtggacaggactggtgggaccgtgaagaggagggcagtggtagccaccctgacaggctccatgcacaggaaggggaagcagcagggtagtggtgggacccacctgcggaagccactccttccctgctgtggggcatccacgtctgccagcctctgcagttctgaggaggtgtcatcgtcagctgcagagtgtggcctgcagaaaaaagagcagaattgacccagggttctcagggcatgacttgtctcccctcctgggtcatgcttagaaatcccatgttctttttagaggctgtcctggagacaaagattgcttgctctgtgacaatgaggcagagatgggaagaagtagcagcctctgtaccttccctgataccatgcagactcacctgctgcttgtcctgtggtcatctttgccattggccttgatggcaggaggtgcatgatggttgtgattattggctggggagctcttcacaccattggttttttcggtcatcctccatgtacaaccagagcacttatctgccaggaagagggccaagaagaaggtcacagaggaccctgacacccacagagagtgggagagtggcaagtgaacaggatggattagaacccaggcccacctggccaacctcagcaccctcaggcactgctgtggcagtcagggcagtgggattcagcagtccctaaatgccaggcaccagggcccaagaaaatgagggtactcccccaaccctaatatgtaattgtaaatggaaacagtgctaaactacaaaatgcgtttgcttttctattttaccccagtatttttttacatacaaactatcaaagctaacacaaaacataactaacaaaaactgtttaagccatcttcctgtgccttcactttgcagatgtctggcacatatttaagctgccgagcagctccaaggcagccactgccccaaagccctggcccaagcaaggaagtgcatctccctgacccagagtagcttcccttttccctaaggagcatgagctctgaggtggtctccagtgaggagaaccagaaagctgggtggcttggggaggtgtggggtagagagcagctgctctgggccagggagacgcacctcctcccttgggccagggctttggggcagtggctgccttggagctgctcggcagcttaagcatgtgccagacatctgcaaagcgaaggcacaggaagatggcttaaacagtttttgtttgttttgttttgtttcagctttgatagtttgatagtgagggccctctcctctgcgcagagcaggagagggacaagtcagtgttctgtgccagaaaaatccctctggctgctctgtggagcctgcattagagggagaacaagggtgaaggttggggcagggaggaggctggacaagagtaccaatggagcccaagacaagagggcagagtgcggaactatctgggaaggagattgaatgggactcagaggagtggatgtggggagcaatggagagagtgggtgggatcacaaagaaagaggagacagagtgagggtctggggcagagttgtggagaaccccaatatttcagagttgcacagaggatgaggtgtccacaaaatagatggagaaggaacagccgaggaggtaacaatctagaggagggacaggagattgtgtcccacagtgtctcttgccacagagtcaggagatacttggaggagctcttccctgccagggctggttggcatgccctaccaggtgtgggcagaaatggtcagcatgacccccagatttcccacagcccatgctgctggacccacagtccggaagctgtccctggagctccctcaacccccgcctaagcttgttccagcctctgaagctgtcaccatggcgatggcaggcacgtcaaacagcctcagagatgctcacctggtgctctctgcggaactatggcaccaggatagtaacgagggcacttgagggaaaggaaccagcatcactgagtccctgcttggaccctggaggcagcagaccatggagacaaaaagtttcaggcaatgcaaacaaagccggagccattcgcaccagagtttcagggctggcctcctggaaaagctggtgttgaagatgaagctggcagatcaaaagggctgtaatccagggccaggccagtgctgggggcacagcatatgttcacatcctctctaaggttctgtcacaaaggcagattcccccaccccatgacccctgctccttctgtaccaggaaacagacccgtccctgagcctgactgcctgcacaccctcccctttgccagaaactgccccctcatgctgcttgctggaaacaaggcagtggggctggtgggtctcatgtatacaccctctccaggaaacctcaagtcccaaggctccagctaccatcatgtcaaatcagctcctcctcaaagttacccacctctgaaaggggcctgccctcttcccagtcactcaagctggaagcctggtgtcaaccgtaactccttgtttcctttatcacatccaagcagcctctgccctgagtagattgtccccacaaaaagcgtcaaagttctgtccacccattgccctccaaccccaaggccctggactggtctcaagccttcaacatggctctccaggcctgctgcagtggactccagatggctcagtgttcactggggtctggactggaggtgggcgcatgatcaccagggtttacattacaggtaaagctctcagggggatgtgtccatccccatatcatgagaacagagaaaaaagctaagggtagagctctggggagctgcaaccatgaaagacagctgaggggctgggtgagtgaaggagaatgaggctggggatgtgagaaacatgagggagttcccagggaaggcagaactttcaggaagggagctgtctgcaaggccaatgcccccctcccatatcaggaagataagtgttctatgccgggtacttcttccccctgagatgagagctggagcgggcactgggtggaacaatagaggcctcgctggggaccttatcaagagtagcgtcaaggagtggtggtcaaacagagcttgtttcatgaagtttcaagcgaggagtaggaggggacagacaagagatagagcacatagctcagtctttctaagagactgagcaagaaaaagaggaaagatagagtgggaactggaggaggatagggggctgacaaaggttctctgtcttgctgttgctgttattttctatgtcaagaagataataaagcaagcttaaaggttttgaggaggaattcagtagataataaaaatatgtgtgcttgtgagccactccagttgaggctgaagcccatgaaacatgggtggaatgggaaggttcaggtaccagaggaagtgacaggagacaaatccaggacaatgggaaggggttgctgagaaacaggccacaagacagttgaagggattcactcttgcaaaaccccagtgttctaagtgaaatgggagggatggggggatctcatcttcagagacaccaggcagcagtaggtgcagactttggaggccagaacgtttgcaatagctgctgcaaggacagacaggagataccaaacaagtgcgaggacaagaaaaggcttggcaaggaagatgacagaccatgtacctaccaaagagaacagagatgggcaacagatcttagatgagcagtgggattctcaaggagggtggtttaacaacctagagtaaggcatgattatttggtaaaaagtccaaacacagtcaaggtggagttgtaggcctcttttctccttatccacaagttgagcagccagcccaggactttaaagaaaaaccagcctagtcaaggagtttattgaaagaattttgaggaaaattccttcctagagaagtcaagtcagagagagaaggaacaagttcatcatatagccaagattagaagtttcagttcatggcccattcattcactcatctatctcacacacatccccaagacacctactatgtgccaggtcctttgctgggtgctgagtttagaaagaagtgtctggcagtctcgagctcagtggtggtcccagagtaagagatagacaggaacacgatttatcccaagtcacttctctgtccatgttctattgtgtttctgagcagcatctaacagtttatccacgccatctttcttgaaataatagagtctactcccttcgttctcctcctcctcactggccacttctcagtgttctttgaagaggcctcctcttcttctccaactctaaatgtcggagtgtcccaaactcagtccttcaatggacttcttgtcttttctctcttcatcacctccttctccagtctcatggctttaaatacgtctgtatgttgatgacttgcaaactcttaacaccagttcaacctatcccatggatagtaatttacctccctcacataaccacttggattttgaataggcatctcaggctccatatgtccaaaagtgagttatcttcccctcaaaagcttatccttccataatcatctgcatctcagtaaaggcaaagccatactcccagttactcaggtcacaaacctcagcatcatccttgactcctctttttttcataccccatggactctacatatatgcaaatcatatgggctctaccttcaaaacatacctcttatccaatcactttttatctccaccattaccacgttaatcaaagctaccaccttttctcagtgcctggaacatagtaggtgctcaataaataagttttaaatgagtagtctatgcatggtccctgcatttttcccagtccattactccctctctttttactttcattgcacagcataagattctgctatatcaattatttgattttaaaggaacatgcaacacttttcctcttagccaacatggggtaacagggatcatatttttcctccagaatgaaacaaccaaacatagaaaaaatatgcgacacaacagttttcaagactataaacgttaggcaacaaaggatagctattcctaagagacaggagccaaatgtgaatctggtgactgccccagattactcctttgtgagagtttccagacgatggcacagaggggaatgcaggtggaacttgatggatgactccctgggttagggacacagagaacagaatgaaaggagaccaaagcagctaaagtttgcagaacagggtactgcagaggagagagctgcacagagagagctctggagacctgcaaagagtctgtcccaagtattcatctgagtgcttatttgcacacactgatgagggggttacccacagcttaggaaagaaccatccccccaaattaggcattacagttcccagctctcacacagggcctggaatagtgtctcatgccaccagtcaaactggaaacctagtggttcatgggctattgggtagagtgcctagaaggggcttgcctcactcatgaggaataactggtcctttcactgagcactgttctagtcctactgaaaaatcttaaaagcaagacccaaaaggatcaaactctttccattaacttcacaccagaacaagcctcaagaatgtttctagaaatacaaaaacacacagcacccaacaaagtaaaaatcacaatgtgtggcatccactcagaaattatcagccatgcaaataaattctcaataatgaggaggcaacaatctatcaattgaaataaacccagaattgacacagatgtacaattagtacacaagaatatgaaaacagctaatacaactatattctatatgttcaaaaagttaagcagggccatgaaatatataaaaagatccaagtcaaatttctaaagatgaaaactacaatatttgagatgaaaattacactatatgggattaacagaagatcagatattgcagaagaaggaattagtgaacatacagacaaacttattttaaaatgaatttacagtatttatttagacaataaaactatccacaatgtagcacagagagaaaagacaatcagaaaacaacaatagcagcaacagcaacaacaaaaggcaaagcgtcagtggaaactacaccaaggcatgtgagtatcaaagtgcccacatccactgataatagggaaatcgtaaaagttgcccgagaaagaagacacattatgcactgaatcacaaaagtacagatggcatctaatatccactaacaaaggtacaggtgacaacaagacctctctgctaagcttcaggctttccttccaacttccaactggacattactctctggctgcccttggaaaactgcagctcatcttgcgtcaagtcacactatttatcgccaccatcagccctttgacagatagacatttgtgactgactgggccttcagaccctcaactgctggcttccagggtggcttggcattctaacttctccctgaagagcatgcccaggctccctctccctgtctacagctttctgccaagtttccctggtcctagggtgaagcctgtattcagactatgccacccttcttgccaatactgcctgcactacaatgtgtactgcctgagggcaggcatcagtgtccgtgttcttgtccactacatccctgcactgcactgagggtggctcctgaaaagcattgcctacatgttggtggaaggaaggaagagagggagagagagggaaaaagacataaagactagatcttggtgaagttctgaggaatctcagaagacagagctcagaaaagggaactcctgagcctgaagcattgagcaggggagaacagatgcaggaggtcttcctggggagcgggttggtgagggagtagctcatgaaaccggtttctctaagtaaccagacgtcccagcttctcatacaacccagcccatccttgatagaaaagcagaagaagctcaataaggacttaaaggattcaatcaatatagttagaatacttgatctagttaaagcagaaaaaaattacatcaccccagttggtatagaaaaaatattgaacaaaattcagaacttatttacttttttttcttgtgcaattttctaaagctataaagggagagttttcttttttatactttaaattttagggtacatgtacacaacgtgcaggtttgttacatatgtatacattaaatatcttaggaaattagaaatagaaaggaccttctttctattcctaatatatacatagaaatatatatataatatataaatatatattatatataattataatctatttcaatattaagaaattattttcctttttcatgggattaggaattctaggtagggcacggtggctcacgcctctaatcccagcactttgggaggttggggcaggtggatcacttgaggccagcagttcaagaccagcctggccaatgtggcaaaacctcatctctactaaaaatacaaaaattagctgggcgtggtggcaggcatctgtaatcccagctactcgggaggctgaggcacaagaattgcttgaacatgggaggtggaggttgcagtgagctgagattgctccactgtgatctcttgtaaaaggaattttaaaaagtacgtaaactatcaccatttctaaacactactgtgctggattcctcagtcagtgcaataagcaagaaaaataaatgaagcgcataagtactgggaataaaaataaatgttttaaatagagtatggttaataattcatagtatatttcaaaactgctaaaagagaagatttgaaatagtctcgacacaaaaaataataaatgtttgagattatgagtatcccagttacacagatttgattattacacattgtatgcatgcaccaaaatatcacgtgtaccacataaatatttatcatctctatgtatcaacaaaaaaatttaatgtaaacaacaaaactatgatgatgaaacagtaggaaacattttacataatattgagttagaaagacaatatcatgaaagaaaacattgaacataaatgcacattaaacccaacatttaaaagaatacaataaactgaaaacaaatttgacagagaaagaaaaagattgattttttttataaacagagatcttacaagtcaatatattaaaaaaataaaaacagtaaaatcacaaaaatacaggtgcaaggatgctagtcacagtgacgtataccttaatgaattaatcaattaaccgagtgaaccaagaccatagggtggaatgctatgcagcccttaaaatggtattactattgtaaaagactacttcttgtcagggggataccaggtttcaaaatggaatgttctgttatgttaataatttccatgcatgcatgtgtgatatatattcacacgtagatacataaactcacaagatcaagactttatttctcaattctgagggtgtggggaaattgttttcttttgtatattttttatagtgtccgatattctgtattgtaatgtgtgatgtctgtagtcgggaagggaggttatagggctatataataaaataaaatattactttaaactttagtttaaaacaacaacagcaacaaaaatccagcccattttggtttcaggttcaacttaataccaggtcaagccaaagtttttccactgatactgggaagggatcttctccatggttgacagcctagagagtcagactactatacgtcttagccagaaactagtcccccaggtagtcaatatctgatatgttttaatatcagatattttccattgcagtggaaaaagtcttgggtggcaggcagagaatgctacagaggagagtcatagacatcatggggggcagggtggtagggcagacaggcagagaagcagggaggtgtgtgggtgagcagcaatagctaagtcccagaggaagaagtgggtatccctgacaggaagctggaatctggtgattcaggggcaggttctcattcatggagcagctaccttgtgctaagtacttgacataagttaattcgtttaaacctcatgacaacctgacaaagttgacactattcttatccccgttgcacagattcatacctaagcaatttggctgcaaaagcaccctcagtcacagggccagcttggaaggtaaaatgagccaggaagtgcacaagtactaaaaagagaggtatggtcagaactgcactggaagcagcaggctcctgggctgacttttgagtgtggagctgaagctgccatgaccccctgtgcccaggcttaggagggacagtgggggggggggcccagctgtgataaggtgagctgcaggagctggaggtggagagcatgccgggcactcactaggcaggtagtgggcctttgagtctgagctgcctcagcctccctgagttcaggctccagcacagcagcttcatgaactaggtccttgagaactacttgttgaatgaataaaatctccagaaggatacacaaaaggcagggctttgcccaagaggcttggcaggccagcatggttgatcactaccttgacaaggggctacagtctctagtgtggacaccactatgacaaacttaccatgattgggctgctttgccaagggaggcttcgtctctttatagacaaagatggggctggggcaatatgcctggcatcagccacatacagtccataccccaggggaggctcctcctagaaggccgcccaagacaggctggaccctagtgattgtagctcatctccctaaatgctcctgacctcactgagaagcccctcctgagctccatatcttcaggtgcccatgggccaactctgtctcctagaggaagacactgggcccctggaaccaatatgttcaaactgacatgaacttctgcccctccgccccagctcctctgtccccagcaccttatctggagaaaggcacatcttgccccacatgtgcttaattcagaaacctaggagtcatccttgatacctcgcacccgctccccaaatcatatttgttattctgctggaatctctctctagcaccttcttctccatccattctgactgctgctgccctgggccttgcccagactctgtcacagtctcactgtttctctatttccagatcccagctcttcctttcctttatcttccacatcaccagggtgagttcataggactacacctggtcctgtctgttgctcctctgaaaacccatggaaagaagaccgcactctagaaataaactttatgtggcaaggactcatctaatttttttagtcattaatctgcagagcagagcccaatggtaagcacgtaataagtgcttgatacatatttggcaagtaaatgaatgaatgaatgattctcccaagtctaccttgtttcatgttcacttttcccccactttatttgtatcatagatttatcatctcctgacaatgaactacagattttcttgttccctgctacatcccaggattagggatcatgtccagtatttgttggatggatggaaggatcatctaaataatacattccaaactctgcactccggctttcaaactccttcaggttgtcactagacccatgtatgcagcctcatctcctgtggggccattttgtgttggagcttagtgggggtgtggccagggctggtcttggcagttttgtggccaccatgacacctgcagatcaaccaggtacatattctgtctgccacatgcatgtgtccagtccaagcactagtgtccctccctctggagaaggtggtcactgatgagtggtactaaggagcagttggagggggcccagctatgcagaaagaggggcccagggacccagctactggcaggatgtctagagatgaggctgctccaatactagctgcctcctatggccacagtctcacatggacggagcttacacttgccactctgggctcaagctgagatggatgcaagctcagctggggagcccaaacggggtaccaggcctgaagcagccctggaagcctatctctgccccaggcctgctgcctggctccagaatcttccctcagccagaagctccaagggcttcaccccacatgcatttccccaaatggcagagtggctggctcccaagcctgagaggcctgaagtgggtgatcccctctaaggatctccgaaagaggtcagggtacagttcaaagagccaaaagcaaaggctgcaatcccagcatggctcctgggagaagcccacataacccacacccctacctccactgctactcatatgcagagagccacaggctccaagtgaacactgcccgtgctctgaagctgaggggcccagaaatgctcggagtcagacaggcagtgaaggcctatgggttccccccttcctcccactgaagcttgcctgtcgggcaggccctccgtccctctgctccaaatctgctccagcaaccctccctgccaccctcctgggaaaggacaaagtcccagctgcttcaggacaagctttgtgtggcactcagggcctccaccctcctagagccccaaataatttctttggctgctttaacaggggacaaagtttcccaacacagccactttcctcagctccctcggcagatgacacatatgaagacccatgtcaagccaggttctagggcccacgcacttttcacggactccagttctgtacccccatggaggtaactggcctgtggtcacagaaaggtatcagcccaaggtcagccgctttcctcaccaatcagatggcttcagaggcaggggctctcctggccagtcagcatccgttggtccttctgcacaacctccagtcagagacaaaccactgggggctcatcggcatctggagctaacagagatctcctgccattcctgcccctcaggccagcggggcccttgagcccctgacaacttagctgcagcctcggggtcagagagctgccccaccctgcctgaggccaacaggagaagctggcagaggccaagaagagctcatgctcatggctaaggcaaactcaagacgctgccccagggtgtcacctgcccaatggagaagctggcctgtctgtgggcactgtacaccccaggctgttggcaggcgagggctgggtgctgggctgcctggctgtagaagctgcttgcctgcccagatccagaagccagcccctcccaagctccctgaggagccctgccttgcacggagcatgctcagagctatgtgtctggggattcaaccccaccagctcacagccctggtgtacttgcctccagaccttggcacaatctcaaccagtccacctgatctgaggtcaagccagggagaaatctgagagaagaggtacctggggtagggctggcctgaggggaaaatccataccttctctgccaggtcccctggacttggcctccaagaagggttggggttagggaagggaaacaaggcaagacccttggggcagtgagctttgggctcctttccaagaagccaggatttcaggctgctcctgggtacaccagagtcccctccatgcaccctcatgtacccctcctcacatgcccaccttcctcttcccaccttccaccagctgccaggaagccagcctgtgacaaaagaactggaatattgagtttcagcttttgaccaggactggcgggggaccaggggcccacttggcagggcagagaactacataaatggaggattaaagctttgcccacctgcgcagccagctgggaagacaagccactccctcagggggctgctaggaggggcttaaatgacatcctgcgtgcaaagcctgggatacatacaggtgcgcataatctgcatggaacagcatagagagttcgcaaggatacgcaccaaccaaaccatgggaaataattcagtggagggacttggcatttggggtgcaagggactgtgttagctaggcctgcaatgtttgcctttttggggagaatgtgttcatgcacaacttgcgtaattaaatatttttaagatgcaaagtgcatggcacagagtaggtgtgccgtaggaagcgaagaatagaattggctccctttggtggggaaaggttttcaacagaaggcataccctaaaggccaggaggggaagaccagggctagattcaatctctggggaccctaatcagaggccatcctgccagtcctttacttgttccaggagtgcagaagacaatgcaggctaccttgtgccctcaagaagctactgatccagtggaggactgatgtgtacccctctaatactaagcctgggcagcccctgggaagcttcaaagactagagaaaaacagcacgccaggagaatcccctcccccacccccaagtaagaatgagttccttccctccttcattcacccacagcatcctgcttcaccatggggaagttcatggcttgctggaggaagggctgggctcagggtggagaggttgggcaaggcaaggacagtttggcagagaaatgcaatcagatgggcaaatgctctaggtgggtcagagccagagggccaggcaggaggtgccaacttgcctcctggcactctgcccccgagcctccctggatctcccagaggcttgggaatcacagatgtgccagcccccacaatatggtccccatgccccttaaggaacattgcagaggggcccagactgggcagctctgactccagttcctctcaggagcttcctgaggtcttctaggtggggcagggagttctagagatagagcaggaatgcccttctaggaactggcctccagccctgctgggaaccagccaaatggtcacacagaaaggcagggtggaggcccagccacgggctccttatgagcccacctggctcaggagacgttcctctagggcactgccgtgctgtttgtttgcaactcaactaaattgctcccaagggtgaacctttgtttcacaacatattttcagccagactttttctgcaaacatgtccatgtctgtgcaggctcacaaacactcaggtcccaaagggcagacccagcccttcccagctgcagcctcctcttcctctgagcttccctgtggggcctgactggggccggagaaaggggcagcccggggtagacagtgtgaaggctggactcatggcagttggagcactgggctgatggcaagaagctgcacgtgctgcccctgctccatctccctgcttcccttaatattcctctgtatcttgggtcctgctctgtcctgaagctgcaggaaggggaggggcggcctgcaaggaggtcccccagtcttccatctagcccatgggtgactcctggggccccaggccccatttgcagaggacagggaacacccctggtactccctggccctcttggctctcctggccagaagtactcatatctgggtgctgctgtttccccattctgcagaggggcttcctgtggcacttgattacctctgtgctctgggaccagagagagaatctttctctctggtgtttctttcctaggtgtccttttctctgctttgagcagggcccaggctccaggggccacgtgcctcgtgtcccacagggctgacaggaggccctgcatcctcatcttagaagtattgcaagccctagagtgtcaggcgtggaagaaccccctcattgtataggagcccactgaggaccagagagaaagaggtggagcagggacagagcaggctctgggactcaagcttctctctctctctctctctactctaacttccctccctctgccgctctgtatcgctgactgtatctctctctctgcctctcccttcctccatcctttcttctctcctcgcctcccctcctctccctgtctcttctctgtctctctctctcacatacacagacacacacgttcatttcatacctagggactaacacgcttcccagtctttacagatggagaatccttgacagatttgggggattagggaaggtgcacttagcaactaaagccaatgagaaagttctgggtcagagacatgtgtgttgagcccttggtcccagggaaaggggttgcagctcctctgcaggcctcctgcaccaggcacatctgcactgtggtcaggcccccacatggcaggcaacattctccacctctcaggctcagccccactggacagcccagctattcaccctgtctgaggtgtgcttcatgggctgtggacccagagtgtgtggtgggtagggtgaggggtatgtgtagctcccgttcagcctccagagctgaggcaggacctcatctccagtgagtctgtctgcaggaggcaggccaagccctagcgtaggactcaggagaactcacgccagagaactcacatccaggccctgtctcactggatgacccagggacatgtttcctctctctggaattcaatttcctcttgcgcaaatgaggtttctggtccctttcaggagatttcctctgattgcttccctgcaacacagcgcagacatgctcccagaaccacacccccacaagcactggtttgcatgagcccaacaggaagaactttgcaaagctggggctggggacagggaggtgggggaggtgaaagggaggagggaaccagggcccctggggcaatggcagaggctcagtcccagccacaaggtctctgtgaagaggagctgttgtttcccagcgcaccccacctccactgttgcccccagtgagtgctggacacaggaacctcagccacagggttttgctgctatggctgaacttttattgagcgtgttgtctgtgcagagcgctgtgcacgaggtggaagcaaacgagggaggaaaacaaagccacacccctgcccacagaggatggaacagaagggccgctgaggtcaggaaggcaaggttgccactaggtgttactgtggggcccagatgccgccatgctgttcacccttcaaagggtggcatctcagcccacgcagtcctcctccagcttcgcagcagccaggacctcccagtgcagtgacctggcctccccaggtaggaggcctaaccagagttgaaaatgatcctgacgctcctgagggctgctgggagatgaaaggggcaagggcagtggcggcctggggaaagaggaaagaaagaaggggaagcagggagggctccaatacggaggccgcgctggggcgatcactggttcatccacagccacaggttggcaatgctggccgacaccagcacggcgatgatcagggtctccctgtggcgccaggtggcgccctgttcctccagggcgcgcagacgccggttgactgcatacagctgcagaggagtcaaaggcagggctgctgagcgaggctcttctccagaagcccacagcacagccatgggaaaagcataaagttagagcaagaaggggcttgattgccctttggcggtggagcggggagcgcccctagtgagaagcaggaggctgggccaggtccgcgggaccaaagacctggctgctacgtctgcaggccccacttttgccttctcccttatgttcacttcccttctctggaagagaccagcccattccagctgcgccggggagccaaggaagaaaggatctcctcctaagaaggtctgggtttggtttgaacaaaggcgacccctctctcagacccttaggtatcactctctctctggacatagaacccttatccttgtatgttccctcttcctccaccttttatctgcccctattccctaccagcatctcagggacagcagtgagtttgaggctggacatctatgcggggtgtcagagccatggggatgaggaggaagaggaagggaatctgccccacctccagcgctaaagggaaagatgactgtaagggactacaggaccccagctgtcgagccctgcctattccaaggcactgtgattctgcttgcacccaccgattgggtccctcctcacctgtcttctcatgacttccatctccagtacattgaactcttccaggctagtctgcgccactgcatctgtccctgggttgctgggagagaaaaaagacagatggtcaaagctgctggtggtccctggcagggagcacaagaaggcagtgaggtcaagcaggtaaggtcgtgatcttcttggacagtgactctatcagcctccagtcctcttccatggtaaagagggcctagggccttgagggctgggagtcagcctgagctagcctgagccagcctggcccagcccagtccagcccaactcggctaggccgcagagcactgggatgccccaaatgggcagggagccagggtactcatggtctctgacagggaggcattccaggccctcatgactccatcctggccaggctgctcaccagcccctctgccccactccgggccctgtctgagcagccagggcccacagaccctcagctcttaccgatcataatggaaacgtatgccttggaaattgccagcgtactcctggagatgggcatccccatggcctgattctctcagcattctgggctttggcagctgggacccctgaagaaaggaatggtcagtaaagtagcctgcccaaccccacatgagtggcttctccagtttgcccagagccaatggtgcaccccatggggaatcacatggtgcctggtctctggaatcaagggctggcagcttcaggccgctaggaaagcttgggaaccccacacaggctgctggccaccaccccacccacaccatgctcctcggtagctcttggtcatccaggcaggctgtggcaaaagaggagcagtaacaggggtccctgtcctctgcaagaactttcacatgcaggtattagctgagaggctgagcaacctactgaaggagaacgtaaaaccttgattggcagcccaggccatggaggcctggcgagatgcctttactttccaaggatgcgtggtaaatgtcagggctaaggctagaaccctggctactgggaaaccagcaactcctctgggtaagctcagccagccatccctgtggctttcatttttatccatctgccaacaactccctagcatgtacatctctggcccagagcccttgggccagggccatctgatgcctttgaagcatcagtgggggatagaggaaaagagcgtggcttttggtgccagacctgcctgggctcaaatcatagttctaggtttccagttcaagatgaaatgtttcacaagctgcttatttaacacacaccacatgccagggaccatgccatcctctaagcccttaccaatactaagtgactgattcctcgtcacagccctgtgaaacggtatcattatcatcccgttttgaaagtaggggaaactgaaacacagagaggttaattaccttgtccaagtcacacagctaggaagtagcagagcagtaatttgaacccaggacatttcagtccagaggttatactctcagccattacactacgatgtccctcatatttaacactccttcctgttaaggctccactaattgccagtgaagacagtaaaacagtacaaacccataagacagaagacaacacaagaggcatcagctaatgaaagaattcaataaaattctggaatctaggaagtgtccatggaggaactaggcctcattgtggatgggaagcagatgggactcagctgacaaaggaggcccccgccagcagcatccagagaggacttagacctgcaaggacaatggcggcatatcacaagaaaggaggggagggaggaaaacagggcctttaactaatgatctatgtaggaagcagtcatccacacttctcactcctggttggcagccaggcacttaccgccaagccaaaacctgaaccaaatgaataagaaagctggggtgaaagtgacacaaaataaaaccgtcttcattctggcagggttcagggtgccccacatgacagccagttccttacccgctcaccctgctgaagtagagcctgtcatttgagaggcctgactgaggcgcacagagtactgggttagctcttctatttgcctcattcttacaaaaaaatagacaaccaaggctcacctgtcacctgagaaatatctgcagccctcttctgttccgaagtaacaacatcaaactgaaggtggatcaatttctgtgtaaaggattttcataggaactttgccactgcactctgtttgttgcaataaggcataactaatctttctcaagaggagcacacagatattggtgcaacttttttatgaaccgtagttcatggtcacaatattttattttcttaagatacttcaaaaattgcattaaaaagataatgggtattagggagaccccatgactataatttgatcaatgatgtctcttagaaaaattttcagaccattgcttgattttcctataaattggaatcagaaggacaaaaaaaattttgagagatttgaaggcaaaaaataaggatgaatggctgatggctggaatttgtttgtttgtttcagataacatagtttgttgttaacccaccaagtcccaacttctctctgttaatcatttcaaaaaatgttattttaatttccatgtaattttaaaggcacactgcttttttccaagtcagcaggatagcattattaacttttctcacccttgcatattatggttctcctagaggcagttccattaactgttttattcaaaaataaaggaatgaatgaattaataaataaatagaattagtaaattagatttcctaattctaaatttctaaatttaatttataaattcaatataatgtctatattttcaaacagtctacctctagcccttgtagtcaactttaattaaaccagagattatatctcccctagtctcagggacattagtggtttgcaggagcctgacctcctggagcaacttgatttggcttctgtctttggacacaaaaagtcaactcaatatttgacttatttttattcccaggaaacctctaacctggaagctttttttctcattcttcactggggccacccaataaatcatttcagcaatcgagtctccctccctctccaaccttattgccccccagtaactttcaaacttcactgtggtaacagtaaagccaccattttctaaaattttccctcatccatctgaatgtggtgaaaagcactggctacagaatgatgggattcgtgattccctaaaacagtcaggtctacctcctctccaaaatggctcagtatcctttgcaacaatgtggccagcatttttctagaacattcaacacccacaatgaatgtagcttaaagtacagaactatgggactcacatgatttcctggagcagtcaggcctccctccctctccaatcttgttgccttttcccagcagcctttgcaacagcataacaacaatttttctaaaactttcccttacctacagtgaatgtagctagctaaaatgattggatacagaactgtgggactcacttaattctgtagaatagtcaggtttccctccccctccaaaatgactgtgttttcccaatatcatttgcaacattatagccactatttgttctagaacattccttcacccatattgaatgtagcttaaaaggattgcctacaaaatagtcagattcacttgcctggatttctttcttctttctctttctttctttctttctctctttctttctttctttctttcttcctttcttccttcctttctttctttccttttcctttcttttccccttccttccttccttccttccttccttccttccttccttccttccttccttccttccttcctctctctctctttctttctttctttcttgacagagtctcactctgttgcccaggctggagtgcagtggcatgatctcagctcactgcaacctctgcctgctaggttcaagcaattctcatgcctcagcctcctgagtagctgggattacaggcatgtgccaccatgcccagctaatttttgtatttttagtagagacggggttttaccatgctggccagactgttctcgaactcctggcctcaagtgatccgtccgcctcctcctctcagagtgctgagattacaggcatgagccaccatgccagtccacttgactggatttcttaacagccagaaagcataggagcctcacctgacttattgtgtgtatacacgcgcacacacacacacacacgtaccacacacataattttaaatacaggaaagcgttatttcacacaatagatttatagagtaaagtatttatgtactccccatgcaatatttgtttcaggcattctgaattcccaaggttgaacccccagcataggaaaggatgaccctgacctttaattggaacttcctgtcctcatttgccagcttggagcacaggagcttcctcctcctcacaagtcaacgtctagccctgcctgacctggtcaggctagagcccctacaaccagtactcccaaccccaacctggccaccaagtgctgaggaccccatacagtaccattttcttgggtcgggtggcagtcatattccaaactcgtttggctgaagcagagccagcagctttttgttccaacttctgcttcttctgggaggcaccccgggaccgagatccaagctccatcatttctagagagaagaacagaagctccaggagcacccatagaagttgcaccagggtttcttgggcacaaaacacaccaaaaagaagacagagtctccagctttcttgggaatcactcagcacccattaaccactgtccatcagctgatcccaggtctcagtttgttcatctgttcaaaagttaaaccggaatttcctgagggctgagctcgagactaggttactctccagtaacctagagaccaatgaccaagaacaagattccagctatcaaggaactgaccatctgtttgtgtataagggggaatgacaggtgtaaaacagaaagcaatctatccttgcaaatgcagacagagagatgcaggctccataaatgatcaaaacagggtaacatagtggaaggaaagggctcctcctagaaaagtaggagacagcaattgaggtggggacctgaaggaaaaaaaggacccagccctgggaaattgagggaaagagcattccaggcagaggaaacagcaaatgcaaggtctttgggggaagaagcaggcttggagcatcgtaagaacaaacataaatgcaatgtgatctggatccctttgtgtgctatagaaatggtattttctgtctatatcatagcatgaaacgttttgaggaggctgatacaatcttatagatcatggaatttggattttcctccaaatggcaggaaaatgaattggaggattgggagagagaattgatctctggtctcataatttgagccctctgagtattttgcaacagagactgtggtggcttggataagggggagacagaggtactacacatgttgttcccatcctcctccctcccagggaaaaatgctcacatcatctatcccttttcccctagctcccttacatcaacccacaaatcctcgaagcccggccaacacacagatgtgcaaacacttccgtgcacacatgcaccttttccaacacacacatgcacaggtatagacacgtatctacacagttggctgtagcctaggggtattttaggggatcctcacctgctatcaccaggtgctcttggttttccccttggcgtccatgattcagttcttctgccagggacatttccatctccgccttggtgttgggagggcctcctgccatcacaaccagctgttctcttgtaagctatggctaaggatgcacagggtgccaggaacagaggagtcacactcagaaaatcacctcttccggaaacaggagctcaaggaagatatagtcagatctgggggtggagtgagactccctctctaggctgaggccttggacacagtactttctgtttctattgtatcttgctggctaggtcagtggccttctcctctgctactctgtaagcaacttaggagaagagatacaattccgtgcctttgcctgtgagaactgctctggctcatgaatctccatatttagcccatggggagaagggtggggtccaccctccatcatttctatgaagaaacagggattggcacagggtccgagagccaacagtggccacaacagagttaggtgctagcaatccaggccataccacaccttcagaagggattctctggagagcgtatcctacctcccccatccagagtccccagacacgggaggtagccttttcctgaagtaggtcagcctaggcaggagccataacaaagggagagaagggcaagagaggtgggacctgactgcagccactagaacccccaggggcctcaggccctgcaccttctaagtcccagttctccctcagcttccctactgattagaccactgtgatggtcaggtttatgtgtcacctggccaggttctagtccccagtgactccatcaaaccctagtctaggtgttgctgtggaggcattttgtagctgtggttggcatctacaaccagtggacttgaaataaagtagagacccatcctcgatgatgtgagtgggcctcacacaatcagctgagaggcctgaagagcaaagactgaggtttcccaaagtagaggtaattctaccccaggactgcaatgtcaactcttccttgagttgccagcctgcagggctgccttgcacatttcagacttgtcagccccacaatcgcataagccaatttcttaaaataaatttctatatacttgtgcatatgcagatatatacatacatacatgcatacatacatacatacatacatacatacatacatacatatatacatcctatcagttctgtttctctggaaaaccctgattgctacaactacctgtggtgaacccttcattctaggaaacaaccccagagcccctgggggaataggaggctatttgtaaaaggaatcaggacaggtttatataaggttccttttacaaatagcctcttcttcccccagagcccctgggccaggtgggaggaagaggaggaaggaaggaggaaaagaagaaggaagggaggaaggaaggaaggaaggaaggaaggaaggaaggaaggaaggaaggaagggagagaaagtggaaacgaaggggccaggagtagctgagatagggcggcatggtctgaggctgcctgccccctgcccccacctcacctgtccagcttgggaaccagagctgatataggccctgcctgcattcctgggggccccaaagaagcccttcccagatccagtggagcagctgtgatgaaattcgagctttctggagggccaccttgggagcagagaaactgctgagtgtgctcagctcagtgggattcaggagcctgggaagcccagccagattgagcaaatgaaaatataggtacgaagtacatttaaatttcagataaacaacagtataagtattctctcgtacactaacttttgggacatatttacactaaagaatgattcatggattgatttgacattgaaatttagctgcatatcctgtattccatctgacaatcttatctcactatgacttcaagattttaccttgggcaagtttctcgcttcttttggtgtcagtctcccccatggacaagcctccctacagggtggctggattgtgaggagcactcagaagtcagcaaagctagagcagtgtgggcactggcttgccacagggcctcgggctatggaggccagatttctgtctcgctatcaactggccctggtggggcttcttgggcacaggagcacagggtccaggtgcatgtggaggcactgccccctggtggcataggaatccaccacctaaagccaagcaaagagggtgggagaattccttcccaatccctgaacccccaatgccactcaaaaaccccagcatctcacccccttagcatgccttcctttcttggattgagtgccaaggacaacttggaggtgacgagagtttgctatgtgcctttgaacttgtctcttagcatgctagctaattataatttcataattatcatctgcatggtaatctccttttgaaatggccctaaattcgtactccaaccattctgaaaagccccctaccccaaagtctgtgtgctaacctcagggcctcgaaggactagagcacctgggatacagagagagacctttcaagtctcacacggtgcctgggtccaggaagatggcacatggccaagtgtacataacaggctgcagagccctaacactccagtggaaggttctgctcacccaaaggttcaacagatgcttcttcataggggaaagaagggtccagaacatacctggcttgtatgtgtgtctatatgttttcagtgttcagtgttttgcacaattgagatcacctacatctgaggtgtgtgccatattctgcaacttattttttcaagtgaaccatgtgctttggggaatctctccgtgtgaaaacaaatctacctcatttcttctcagcccagcatagcatttccctacacagctgcctccccttgctcctttattgacttgctcatggatattttgggtgtctagagcttttatatttttagaaacaatgtagcactgagcattcctgaacatgtctctctgcacacataggtaaatgggtttgcacagcaggtgcctataagtggaattgtggggttctagggtatgtgtgttgatgattttgacctatatggaccaatattgtcaaaggagcctccaaagagcctgcacaaagtgaagcctcacctagaagaaagtccgtgtttcttcccagtctgatcaacaggaatattatgcaactatttaaaaggcttaatgggtgaaaaatgatatccatctcattgttgctttaatttatattactttaattatgaataatcctgagcaatttttcatatgtttattgatcttctgtatttctttcccatgaactgtctgctggagggtttggatctttattaaaataagagctattttattaacagaaaagaataagacaaaaactctccctcctttcaagctaagtatctccaaaggaaatgtatcatctttttccctaagggggatcgtgagcacagagcctccactggggaccaaacaaataaagttaattgcatccaagcttttgctgaaacctagagggcatccagccacccacggagcaggtgtccaactcaggctgctgcctgcctacctgtccatctgcccttgtgtctgtctgtcttctctgcctgcccccagccagcctgatcatctgcctccaacagtgccttccaaccactagcttcttccagctgttcagtcagctgagcactctgctccatttcccagcggctcagggtcgcagctctgtctgcccccagctcccacctcccttgcaagctgcagcaggagatggcaggaacctagcccaaaatcagcacatctgtgagtgactcagaaccctgccactgggacatcttaggcaggttgcttcacctgcttggagcctcagtttcccatgttcacgtggaagtttcagggaggtgtgtgggggctgcctgggcttcaaggcagactctactgttcttcatccagagcagctcagctcttaccactttcttatattggggctttatgtaagaggtcgttgaagccaaatgtcttgaaggaaagtaaaaaaagccactgggtgtgatgacttcctatctcccagccctgctgagagcccagtctcaggcagctacagccccaaacccaagcaaatgggtgcacctggatctttcaggcagctgagagcttcctcttggcttgttaatgaaccttatggacctgtaaacaattctccttcctgctcctggaagcagctggtactgaggtcatccctggagccacaaagccctccctgcgccagagaggaaggggaaaggagactagcagagtcttgcatctctcccgcctctccttaaagaggcaggaaggacagacagaaggattcagggtcaaactgcagggaccatagctggcccagggaaggaaggccaccttgtgagcagagagagggaaataaaaagtaacagggccacttagggcagcccttaggacccactcccatggggacagagccaccttgatttctagctttctgccttgaatcaagattgcctgtgtgctagacactggggatggagatgaggtccctgtcctcacgaagttcatgctgtagtgaacagagaatcaaatggacaggaaagaagtccatctctctgtggggacagtagcaggcagttgtttgtgtggcggccatgcccttaaccctgctgcactctgcctgtcttggagtgtggtgggtgctcactatagcttggcaaacctaagaaggaggggcgcaagggagatctgtcccaagcaatgtccctggcctctgtagcctctgactgcacacctcctggggcagctcgctacctcccaagggggctgagatcagtagaaacgtcttccctgcatgggtggaaactctggcacagtctggggggtgggggaggagcagcttcagcagaaggaagttaaagatgcagacacagagtcagccttggctttcaaaccagcaggtaggactgcggttgctgagatgctaagtggttcccaaacaacccagtcctccaggcttaggggtccagagaccatcctgctgtgcctctgagttccttcagaacagcaccttgagattccccctgagaaaggaaggctctctcagcagctcaggtggagctgcaaagagctcagcgtaattgttgttggttgactgccttagaaacaactcgggaccaccctgcatgtgacaaagaacagcacccagaaagaggggaaattcgcctcccagcgcagccagttgctgtcactgcctgctccttcttctgccttctccttttctcttcactggcccaagaaatccttcccccaaaagctggcagaaggttcagagacccagaggggtttgtttcctgcctatctgtcacactgtggcccagtgtcaccctgcccccagctgagaggctagggcactttgctcttatgtccagagatccctgggagctggtgggaaagagtctctttcctgatcctcaggaagggggtttgagcaaggtgacctcacaaaatccttggcctcggctgtgtggtgactcctcagatcaaaatgcatctgcttttaattgtttctgtgcccaatgactgaattgtgatgtgtatgtaaaaatcaggagaatcagaggccgaaggaagaggtagaaaatgtggtacaaaacctcagaaaatgacctgctcaaaacacaagcagcagctgcccctccaagctggagaaagatgttggagaggaggaagaaggcccaaggtgggaagcacagccctgagaagctgcatgggtttttttttcagacaggaagctaatgacaggtgttcccatctatgaagtggttactattcccagtatgcccccattttacagatggaaaagctggacagaggcgggaagagagggctgagatatgatccagttcactgattcagtgataaaccaaggccatcacactaacactccagggtgctcgctagaccaagaggaagtcccaaggaggaggtggctccagagcatttcagaaaacatcctccagcccctattctactctgacctgcccttcactcttagaagatagagaccaacagagaccttgtctgctttgtttgctggctcctcagcacttagcgtgcttcctggcatattagaagatcactaaatagtggttggattggaatgacctgaatgttaaaaaacaaaacaatccccccttagcatcttgtcttttgccgctaaactttctcaactcctggaaagtgttgcctccatcatatgcactgtctccacttgttaccttccaggcatcccactgctcattctagtctggcttcttcagtcaccatggaactgaaatcaccccttgccgaggtcaccgatgaccccctgatggctccatacaatgagttcactttggctgtcatcttccttggcttcttgaaagcatttcacatcattgtccactgtctccttctagaaacactctagtccttcggttttcagggctccatatgccagtgcttttcttcccacctgtctggcctccctcctgggccattaggtccacactcaagaccacttgttgtctttctgggacctcaagcaattctgatctctcctgttgcagcctaggcctccctcctcaactacactcaaatgcgctatacaccacacatgcaacacgtcaactcaaacctgtggtcttttgctcccctaaacctgctcttcctcaactgtgaccctttccagggaatggccctaccatctactctactgtctgagcccctaaacctgaaagtcctctgggattattcactaccccttcccaacgcaatcagtcaccatgcatggttctgcctcctgaatagagaattcagtgtttcttccaatgtgacccaaagatcccctgcagaagaatcaactgagtgatttggtcacaatgcacatggctggcccaaccctggactcaaggtatcagactctgagggtggggtctggagatctacattctaagcaatcagatagtcttgtgcccatcaaagtttgagtaaaaaccttctcaacagtctatctctctctgtctcttccgtcatcagcctcatccatcccagcgctgtctcttgcctgggcgatggcaataacctgacctccctgacttctcttattcttcggctcctgcagcctgttttccacatggctggcagagcatgcctggccatgcccgcttgctccttaaggcaccccttggtggccttcgcttatcactagggtaaagactacagctctgaatactgcctaaagggcctcacataggccgacctccatgtatcttgcaaatctcatcttgcacaggtctttcccctcatgctaccctgtcttctgtttccttaaaaccaagatggacttgctgaactccaggcctcttcacgtgctgcccctctgcctgtctgaattgtcttccatggtctttgcttggctgattgctacccatccttcactttggttggccgtggcttcctcaggaagactttctctggaagcccccagccccacccccctggacttcccctagcataaagttcatcatgcactattgctacagctgttctgatgtttcccccacccagctatgcccagagctccagacagccaggacctgcatgccccagcttgtggagcaccatgctctgccagcacccacccctagatgtcctatcagcccaaggacccagcagtgccaccaccaattgcccacccactgggctcctgtgaccccatgcaaccagcctgatatgaaatgttacccagtctctatttttatagctcggaaatcctagtgaaaccgaacccatcacacagtttgagctcttcagagaaaatgctgaaagttaatgtcattggagctggcggtgttgtgatcccccaaaacaatgtattttgtctgtaaaaacaacctgtggggcaccaacgttgtgtctattcttcaggctttgggttctcacatcacttcccacagaagaaccctggaagaagcattctgaagcccacttctcctttcccaactcacctgccctgtggagacttttggcagctgtcccaagtctgtccagcttggcagggaagaaactgctttggggactggttggagactgacaaggtgcccctctgtctttgccagcatctcagagaagctatgatgttcacccttcaagattttccagaatgtgcatcatgtgcttaggttggaggaaggagcaacagagtcttcctctcatgagtggagcattatgagccaaaatttgtccccctaaaattcatatgttgaaattgtaaacccccaggacctcaacatgtggctgcaggagtaatcaaggagtaattaagtggaaatgaggtcagtggggtaggacctaatccaatctgactggcatccttataggaagaggagattaggagcaccgaaaagaacagagggacaatactgtgaagccacagggagaagatggccatcagcaagccaaggatacaagcctcaaaagaaatcaaccctgccagcaccttgacctcagacttccagcctctagaaccttgagaaaatcttctgtggtttaaccccccagcctgtagtattttgttttggcagcccaagcaaactaatacatggagcttggtctccgattgtagaacacaatcagtccacacgtttttaaaaattgaacacttactgtgatccaggctctgtgctgtgttctagggcagaagtggtgagaaaagttatatatggtccctgcccaaatggggttaccagtagggcagggagaggaagagggcattctggagggatctatagtcaacacaaaaccaacgcaaagtcacccttccccaaaagggaccagcagtgctaggtgcatggcctggggtggggccatcaggacagacccggattcacatgatggatccaggacttcctctctgtgagatcttcgtcaaatgacatgcctttgctggctttgcttccctctgctataaactagggttagttataaaccccatatcgcaggtttctcgagaggattgtgtcagtcaatgcatgtacaaggcctggcatacactaagagctcaataaatgctggctatgatcatttataatcacaattcaggcattttccccactgcccttccatcctgtcactccttgtagcctcaggtcagctactatgagggggtggcactggtgcaggatgggaggctggggagagggcaaggagagggaccccaccttcccaagccacacccttgaggcacagggtctgcctttcacctgatcccctgtctctagggatagaaccatctccctccacagtcaccccattaagtccctggccctgacttgccctcatcgtctataagcaattcaagtgccttggccccagaacctgtgactagattagcaggggaggcccagtccattggatggtgcatacaggggactttggaagctcagggcatccttcatgtattagcttccttgcatgggctggcctgggaccctaagtcactgcctagaacatttgtctctggcaaaagagcctaaagttcaaaacctatgttcagaatatgaccccatctgtgtgcctgaagggccttcgagtttccagcatccccagaaggttagcatcactcaagccccagctccccaaggcctctggctgccattcttggcatttgggctccacattcagtcctctaaggaggtcccaaatttcattgccattgtcccatcacttccagggtcttcccgattaaaggacggatgactttcattacttggggttggcacaactagcacttgcgacttcccgtggctatatctctctgcatacccacagctgggaatctctgggagctaagaccatgtttcctctgtgcagaggctgggcattattgccctctgaacagtccctgatccttgccatctttagaacctaggaagcccagccagggcaaagcctgagtattgtataccttccgctcctctcccagctctgaaaccaagtttctaactgtgatttctgacagatctcaccaacctcatcccagaaggatggctcaggagatcatcttacacactggggacaaactttaggacccaggacatgtctgcttcctgctcctggactgttttgggcttcttccttatctacagtctgactcacaaccacccataccccttggaagtttgggagtcagcagggatccaagatggatgacgacaggattcaagtggatgccatttgctctttattattattgttttcttgtaaagaaggagacaaaatgtaacagccaaattcaacaattataaaaagaaagagagagagagagaaatcagaagcaagtttgtctgttgcccccaggctccaatgaaatgctgacatatactgaatgtacagatttcccagctgacaagggtcaacacatgaatacaagcacagtttaaagtggtatcaaaattaatccatttcacagtaattatttctataagctcagttgcacatatcagggtttccactgtcacaaattcacaatgtcagagcaaaataacagatgtgttcaggcctgggaaattggtatcgatgaggggagatggattgagaggcaaaagcagctgggggatttgtcccaatcctgaagatctgtgttaatgctcgggctgggggtgggtgaagggcaggcactgttcagcagtcagatatcagtacagtgaaacaactgttgaggcattgagcttgagagggtgtgctatttgggtatgtttgtcagataaattcttgctagagagagactcgctgcccacagtctgaaaggaaaagctcccacgtttgaatatttggaggcgaatgatggagcggccagtctgacagcgaagcatctgctttacagaatatttagaaagatacatcatgtgtattagtttaaattgcagtctagttcacaaactatgttattcacaggataaataacggagtagagtgaaaggctgcaatatccaacatccctgtgatggagagagaacaagagatcaccctgtacatacgagaagtgctgaactgcaaagctgaaggcacggtgaagggatccttaatatcttgagccttttctttgaaaagggtactcattttaaactggatttctcttacacaaaagaccctgaacattgactaaagggaagaatatttcaaatatttttatgtagccagaatcacagctactgtgaattgtcttaagttgtgattttctcgaagttctgaagtagtgggcttcaaattaatgggcttttaaaatagttgcaagcagtctgattaccgtacttttaaattagctaattatagtgattagtattagtagagttccgtggcggggggtggggggctgtgcttgtttcggaatcgatgaagtcctgaaatggagcttcattacttgtcaagctgaaaagccacctagaccagcagctctgctgccaagatatccatctcagcctcaactgtgagtgtccacacatgagacagcacacacacatactcctagaaagacagagcctccgtgagcgagagagactctctccatgatctctctcttggacaaaataacaatctagaggcagtgttgaattttttttcttccttctcatgggatgtcactgggttgtcaaaagatcaactctggctgggggttgcgatgctccacccactgggagaggggaagcatccggctctgactacttgacaaaaagacactttcctgtcctgaattcctcatattcgggctaccaaaaaggcaatgtccaacagatcaggcagactcctgtttttggaagcaccctaaggaattcacattcatggcagtgggattggaagttgaaaaagaggcctcccggggctgactgctcagcactgcgtctccctcagccagggctggacgcagctgtgtgggtggtgtgtacacgccaggcacctgtgcaccccactcttgcacttgtgctttcattttgaaaaccggaggcgatgggaagcgggggagggacaggatttcgatttttcttttaaaaaatcttaaaaagtttttggttgaaaacaagtgacagtcacatttcaagaaaatttttaaaaccttttctttttgaaaaatgaaaaacatctaattaactagtcccgcgatacccaaagtcaatagtcacacatctttccatacacacacacacacacacacacacacacacacacacacacaaaaaaaaaaaaaaaaaaaaaaaaaaaaaaaaaaaaaaaaaaaaaaaaaaaaaaaaccatgcccaggagtactcagatttctttcagctgctgacacccacagaacagaagcctgggccaggggcaccatgccaaaagggcgtgtgagcgggggttgcatagggtggagacctgcagaatggagctgctttgtcttcttccaaagcctttttcaaggaggcaaacagtgacaactttgggggttgggtgtccaatatagttaatgccacgtttccttgctcagggccctgtcatcaggctactcagccctgcgaggggaggtgacattcctcttttcagaccggatccctcctggtacaaatatagctgcacaccggctattgtttcagataagcaatgagaaaaggcaacgtgcacacatagatacacacacacacacacacacacacacacatagaagtccaaaaacagcaaaaatgtagccacgaaagagtcagcattgtatcaaatccacctccatacaaacacagagtttgaaaagatatgtacagggcattcataaaatccaagtgtgcatcgcaaggagtgatgcctgctgtgtgctgtacagtcttttttctacaatgtgctgcagaaaccatcccagagaccgtggtgcaaccccacctggcagaacaccatgaagcatctgaaccgaacatcacaggccttaagcaacctcctgtgactcttcccacggcctgtcctcagcccctgaaggacacatgttgccctccatgggccaggccttgggcctcttcctgctctctcccattaccacccagctgcaactcagatgccaaaggcagcgggcatttcttggcaaactccctttggctctgatcagtggagctcatgcctggctctgtgctaactgagtagacatattgggataagtttcttctcacctgctcccaggtcacactctggcacctacttgaagaaatactgggagagccagggctagccccgagcttcaggcttccccaggtcccccaacatggaaaaagcaggggcctcttaagccaaaaacccctttgtgatgaagggcaggagtgcaatgctgaaggcccaggggagggaaagacaaggaaacgaaaggtagaatgtcacctgcattcaccagcatctctggcatcagggagctctggaaagggaggacgagaggatggaaagggtcaactgacgggagattgactctccaagtggagactcaacatcagaggcatatgagggcctcagctaagactgctcccttataacctacacctttctagaagactcttcctaaggcaaacctcgctggctccccggcaattcaagcacttcgcaggcatttgctcagtcagcctccaacgggcctgtgaggtagggggaaggatggaaaaccccagccacagggtggagtggtccaagctggtggcctcactggggtagggacacaagccttctaactggaagcacgtcccagggcaagtcctcagggctagagcagcctccagaagtcctctgtggcctgaaggcagggctgcattcaaggaaatgagtcccaatgtctgccttagagagatattttgacagaaaaaagcttgtcagctcagtggattttaaattgctgtggttgccaatagacgcaggccatgcattcttgcaccacacaaaaatttgctacaatttttaaagcaccacagaggagaaatggtttggtgttgaggtcaggaggatggagacggaagtagggggaggtggtatcaacagtgtctagcatggtcactgacagttaaagggcaggtgccttctgccccactgctgtccaaagcctcactgaaaacagactggcacctggcaacagcagagcaaaccccatatgggccttcaaccccaggccacgggcttctccacaaataaatgttttaaaagggacactttaggatcttctcctgagatgcgcaccatcgttaaggagaaatcctcaatctgaagttcaatttcaatgcaccattcgcaaaaagtaggctcatgccagtgggtagtggtttgaacacagctggtccacatgtctggagagacaagcacactagaaactgaatggcagagtccacgtgggccccttggtcaatgtggaagaggaaactctgccacccagccctctggccctcatccttcacacaccctgtcctccttccaggagtgtggggacaggttttaggggaggcggacatcacagatccatgtgataaatttcccttggcctcctatgaacggcccgggtgctagagttttgttctattgtgttaattatttatttgtcatgattttttcattttgtttttgctcagtccttgtccctgtcctccaaatgtaagcaaggacagaaatcacagaactgtggagggtaaggggtgctgaaaggctggcttccttcccttacccctgaggcccagagctctagacacaggcaggcctccagccagtcccacagcccccaggccaggcctgtggacattctggccacaatcaactcaatggggttattcctttggcataagagaagccagttcctgatggaaagacaggatgttggaggcttgggggtcatcccaaagagttgggcactttggcctttggctcttcccgggggcttcgactcatgcgtggtccctacccccaccctccccacctgtctctgacaactgacttcctaaaactccacagttagggaattatttggcaacaaggaggctaaggctgttttgtggtggcacagtctttaaaaagttaaaaagaaaataggagacctcggaaagaggcgttcatccaggacagggcacaaacgtcccactacttgtcagcgccagggttggcggccactatctcctcgtactttgggggtgggtcactgtaagacacgctggcctcctcactgctgctctcttggggcgcagtcacctcctcgtaggaggggggaggggtggtgctggacagtctggagagagagagctcagggaggtagagggtgctctctagccggactgtggtcctgcccccccgactgggccccagcaccacctgggggctgttcgctgcctctcggtgcccagaaggctccccttggctatgcacagtaccccggtacaccatgacccgggggagggtgtgcccggcgcgactggctaggtaccggttctgagcataggaggggtggtgacgggtcgctttctgcagctggcacctccagatgatgaacaaggcgatgacaatcagcagtgccacccccagaaggggtaccaccacatacatggcatctgagctctgcgaggggtctcggacagagtagactgcatttgggtaccctttccagaactccatctgcaaaagaaaaagtggtacttaagagaagctcaagctccaggtgggctcagaggccttcagtaactctggtgcttcctacccttccccatctgacttgtctcacagagttaccagagaggcagcagaatgtaccaagggcaaaggacaatgctcccaagtgaggaggaccccaaaagagtcaggcaatgggactgtacgtactttatctgctccgtgatggccctagtggctatgccttaggctgggtgtctttccttgcttctgattggtctgcattaccagggcctgttcttgctattcctgaggctactcctactcccagaaccagccccagggtggtacatgccgttttctctttgttctcaaacacttccttgacctcctcgtagctgcagatctcctccatgcactctcgctcgatggtgccctggcgcagctcctccaggaactcattggcacgagggaatcgtttcaggaccgaatgggcatccttggcctccagaaacactgaggagagagccctactgaggcctggaatggggagatgcccaggggctccttcaaaccaggcccagcccagcaactgaagcataattatgcagggaaacaaggccgagtgagcaggcaagacaccaggcttctgatcaaaggacatggccggccctttgtgaaagggatggaagggctgacattctatggtgccatgatacacctgtctagaataccacagccccaacaaggtttaggtccctggctacatggaagaaaatggtagccaactgcaaggaaagtgcacgttgcacaggaacaagaaagaataagaattgtaagtaggcaatgttcagtgactaaagctccagtatcttctgcatcaccttgaaaagtgaaagttggagcccttgcaatgagaatgtattcctctttaaggctgatactggtggaactaataccagataatcctagaagactctaccagggtggtgttcctccacctgaacatccacctgtgccaccaggtggtctggcatcaatagtcttgttcaagaaagtctaatgcaaagccagcctaggctagatcagacaagtgggcatacacgagcctaagagcacctctggggatgggaagtagcagggttcagatggagagtctaagcttttacagacggggcacagaatctccctacaataccgtctttggatggtgggcatatctacttattccagagagagacacccagctacaaacaggctgaccagaatagcttgagctctgcacccacataagcctaagttgagactgtgaaggatgaaagaagaggtgacgtttgctcctgttgttcacctagaggtgggacttcctggttcccatgtaaagcaactccccctggatgcccaagctggcatgtctttgccagcaggcaggcacccttccccaggccctatggcctgtcacgttagtgtcactcagggaagcctgggtaggtacacatctacaagtgacatatacttcagaagggagccaaagagttgagagggcaaaactgctactcagccatttggaaaatggctacaggcccacttggggggtagggggcagggaagctgggaaggacttgaaacctgactcatgaacccctaggcatggccctccacggctctgcccaggcctggaaaaactcacctgccatgatgctccctcagctgcagggtctcacttctctggagtaagagaaaagcaaagttgcagtgaaaccacatctagaaatttacagggcacactcttggctctgggatgtgcccccctcccactggcgtggtcaaaaggttgaagcagcaccttgtggggtgcgtcgtcctccatgcagccacccatggcttccgctgcttctcattctgccccaagctcttctccagagacctccccaggcccagtagggcccaaagcaaacctttcagcgttttcccccaagaacatgttctgagcatctataagaaccaagggttgacctttttcttttaaaaaggaaagctcctaaaggctgaggctcctccttccttgctcccctcaatgaatctttgcaacttccaattggaaaggacctcagagatagatgaggagatacagcccagagagacgggctcagacaaggttaagcaaatcaacagtgacagtggcaggaccagaattcacaactaattttgagcacaatggtgagtcacagatacctccaatgacaagcatgttccctgaaaacaaagcttaacacagcatcaaccatctcaaaagtcactgccctgctgggactagcctatagcaaccttcagtggacacatcttctacagggtctcatcctccatgcacaacaatgctgcattcttcatattcccaggcataatcagaaggcccaaacccaggtgacccgctgtgttcatcttcaccagacaaagaggcaagatacctggaatcttctggaaccaggcctctcttctctctttgcattaaagcccatggcagtagagtgccaagacatgaatttagatgcccgacactgagacgctaactacaagagttgcccctaatgtgagctattgtcagaaagcctttctcctgctaaggagctatccagccagtacttaaaccatggtcacagcacactgctccctctgtccctccccacaatacacacgcccactcatacacacattctagagcccttgctgagctgtccacatctgggagcaatcaccccactgctcccctccccaagcagaagctctggtttgatgactaactggatgcaagacacgtgaactgtggaatccattgagccctcctttttgcctaggctgccaggaagttcagcgtcactattgccagtcaagcacaggcaccctggaagcccagctgttaagcacatatgcttctgtcctgcgatgtggtatacagctttctatttatgtttccagtgtcctattgtgcatttataatatgccacctaatccttttggcaaacaggtaggatataaatcaataatttaggctggtcgcggtggctcatgcctataatcccaacactttgggaggctgaggcgggcggatcacctcaggtcaggagtttgggactggcttgaccaaaaaatggtgaaaccccatctctactacaaatacaaaaattagttaggcatgctgcggtgcatgcctgtagtcccagctactctggaggctgagacaggggaatcgcttgaaccagagaggcggagattgaagtgagctgagattgcgccactgcactccagcctgggttacaaagccagaaagaaagaaagagagaaagagagaaagagagggagagagggagagagggagggagagagggagggagggaggaaggaagggagggagggaggaaggaaggaaggaaggagaagggaagggaaggaggaaggaaagaaggagaagggaaggggagggaggaaggaaggaagaaagaaagaaagagagaaagaaagagagaaagagagaaaagaaagaaaagaaaattaaaggtaaaacagcagatctgacatctatttgtggaaacgccacatcaaggggctttctcttttgaaccctgcaacaatctccctcaaaactatcaacatgtgaatttgtcaacagatggcctgccttgtgagacagttggccctcaatgtttgtcagaaccaagatggaatatgatctcaaaattctgcttgcattatggatacctgagctttatgtggtgagggtgtggatatagtatgcctcatggcaaggattttttgcttgaagaaaaatggagctgttgtatctgggtttgagaagaatgcatatagtcttaataagggaagagagaaaaatatgcttatcaaaggaaactgcagtggttttttaaaaaaatggagaaaaatttacataatagattacatatatccatcttttgtcccccacacacctagccttggtcaaaggtggctatatgtcacacctatcatagacccgaatacatgttatcctgacgcacctgctaaagtcaccagttcatttttaagcttcagtcgagccaggaacacccccaaaacagttcccatggcatggcccactccattagcaattctgtagccaccttcactgctgctgctgcctgccacgaggcctcttccccctccctccccaaaatgtagcgcctgcttcttcccctataaatacaccatcagtagacagttactatggcaacaataaggaagcaatcgtgagggctccacgacaaagaatgatgctgcagccacacatgtatatgtcccccatgcccctggtggatactgtaaagctgactgtaggcggaaggaatttttaacccactccccgcaggaacacagctgaatcctgacagcctggaaaggaaggaaggcagggaactggccaccacaaagaccttgcttaactccaccccagactgaagcttctgaatctcaggcctctgggacacaactcccaaagtccctcacatgaagcctggtgaccaccagagcacctggtgtcccaagacatggcctccaaaccacttctccaaaccctagactttatttccatccctcagaactgatcgccaggaaagggttctccaaatcgcatgactcatcgacccacccagtgacacgacaactcccaaattatgctcaaactcaaactctggggcccccttgtccctttccactcaggccagccctgaaagtgcctgtcctcgcccaccttcgctggacaccagcgccctgacccagcaacactcttctcccggagctgttcaatacgccccatccccttggcccggacaggcctctagatcttccctcctcaacaatgccctgcacccagctcgttggccctggataccgaaccgtgccctcgggactgggacacccaacccaaatggcctcaccgttctccgggcccagaaggcggccgccctgtttgcgcacgcagcccgccacctcgctgctgcgcctcttccagcaggggccctgtccccgcccacctgctccccgtcggccaagccccccggtccggcccagccgtctcctccctcccttcctcccctccccgctgccctcccaccgccccgggcaccctgtcgcccgcccctccagggccgaagtgcgcctggaacccccgcccctcgcagccgggcgcccaggcccggcccattacctcggcacccccctgcctgcccctgctttcctctgggggctccgcagctgcccgccccccacaccccgccgttccagggctggcctcgcgccccgcgcctcgcgcgccacgaccgcagtgccccgatcgccaggccgcaatcgtcgcgctgccccgcgcaccgggccgccggccgcctggccgagtggaggaaggaggggtgggggcgacggagtgggccgagggggttgggagagcgggcgggcaagccgggccggaggggcggcggcgcgcaccgagcaccgcgcgcccgcgccccactctgccggcgccgcccctgcccccgcccgtgccgccggggggcggggcctgactggcgggcctggggcacacagaggacccttggtcaaagccctggtccagtcgtgacccaaggcgtgggccctcggaagatacggcgtagcagggagctccggcggccgctcccaaggcccgcgcgccaggcgtccctgcgcagcccaacccgcgtcctgtccccaccccccgggctcacctgccattcaggcccgccgggctcctggggccaacgaaaagagaggggggctagcctgcaacctaggcctgccttgccagggatccacagggccctcagaagaaggaccgagtcgaggccgcgttccgccaatgactgggtgaccttggcttcttcacttacctacccccaccctgccccgggaaggcaggcttctctcctgcaaagtccgagaaatggggagaattctgcctccctcgcgaggctgcagcgatttgaaggaggaaatgggtttggaaaactctaaggctcagtaaggggagaaggaatcttctgcgactgcaaggagcgctagatgggggctccttcggaggccgcactgtgagaagttcagcatggcaggacaagacgcatagcagagattacactagtccaggaggaaccacatgacaggtccactgctaagagaggggcaaaggggttccgggtgggctgaggttctgggtctaggaaagcctccctcggagaaggggatgctgggtttttagggttcctttttgttctctgcacatctagaacccggccaggcactggggttggcgtcctcttcctccctccaccccaagtgttgcttttgatgggaatgagtctcagaaggcggttccagaaccactcccacccctatcccagggcgggtattagcaacctgccttgccagggggcggaagaggggtgggcgaaggccttcattgccaccggccgcctcccctccaacccccagggcctggctcccctagctcccccgatgcctgcctctacacttctctccccgcatggtgctttcccttccatttctgcctcctgttagagttcttccctagcttgcttgctatttcacggctgcaggaatcttccttacccacgacagctcttctatggccttccccccatgcctccggagcctgtggggcagaattccacagactcttctggaactaacctcttgagtttcctagcccaccagcatgttcccatcgtgatcttaacaccgcatagacccttgtgcacttgactgttaaaaaagcagctcttccagtatgtgcacaagggtctatggcttctgccctccttctggcactcccactttagcttctggctccagccacatgaggctacttctacttcccactgcccagaatgcctttcctcccactgtggacctggagcacttgcattcattcttcccacacagtgcgcatgacatctctactgtgaggtcttgcaggatccttcctgcaccccagtccgccattccactctcaggactatctgcagagactatgaacatgggggcctcggtggatagcaaggtgggggaggaggaatagcagtgcctctggagcgtagtgcctgctgcacctcttggtggtactacatagtaggctctattatctccagcaagtgtttgacctctctgcatctcggtttccttacctttcagatgagaatgatgctaacagtgcctgcctcaaagcgttgctaagcgggtagtggagctaatcacatagaatgtgcctggcgcttaagtgtgagcttaatgcacatcagctggcctgcatccagctaccttgtgttcatttggtagctcacttacgtgcacacttgcctcctctcttggggccagggaccttgtctcttcctgtgtccctaccatctcgcacagaacctcatccacagctggtgctctctagagacttgtcaagctgaggctggaggggctggggctgagaaggcctccattgccttcttacctgcccccatttctgttccggcagagccggaattgtgggtgtatgacccatggagtcagacagggccctgtgcttaagagggctctggacacctggctcaaggctgtgctatcaccatcttgaaattctaatgctttttgaacaagaggccttcattttcactttcactgggtcccacgaagtatgtaagccatcgtgcctatgggtggcatttccaatatccccgatcctatcccaggtaacagaattctcagtcacccaccacttgtgattcctcaccttctcccctctgcaagccttgaccagttgcctctttcctcatgtctcatcaccaccaattccattaccttcctccacattgcccctccccagccccatccctgtgcctcaccctttggctaagaggagcactctctgacaacctcatttactcccagagtttcactctttccccaacactcatccattccagaattgaatggataactttatctgagctctgctgctcccatccttttatgtcctgactgagcctaagcattgatccttaccctgtaagagactcattccatctctgcaaaccgatcaacaagttaatcaggtgtcatggattgagttgtgtccctctgcaaattcatgttgaagtcctaatccccagtactccagaatgtgatcatacttcgaaatagggcctttaaagaggttattaaggtaaaatagggttattaggctgggccctaatctagtgtgactagagtccttataagaagaggaaattaggacacaggcatgtacagaggaatgactatgtggagacacagggagagtgtggccatccacaagccaccaagagaggttcaggagaaactgaccctgcccacaccttgatctcagacttccagcctccagaactggaagacaatacatttctattgttcaagccacccagtccacagtacctactttgttaagacagactgaaacaactcctacatcaagcatttactcagtgatactacgtgctatccactgttctaggacttgggattacagaagccaaaaaattaaataaaaactcctaacctcatggatattagacacaaaaaaaagaaaaacaagtcaaagatacaggatgctagatggtgattggtgccatgaagaaaaagtgaagcagagatttcaaataaggtagtcaggaaatgtgccactgagaagatggcatttgaaccaagatttgaaagagttgaggggccatcctattccaggttgggaaattcacaagtgcgagagccctgggagcagaagcttagcatgttctagggttaggcaggaggctagtgtgctgaagtgaagcaagccagagaggaggatggtaggcgactaggtcagagtagttaagatgggggtagcaagagatcatgcagggccttgtagaccactgtcaggactttggctactagtcagagtcatgtggagagacagtgaggattctgagtcagtggttaccacgatctgatttctattttacaacaggcaatgcagtggaggtggtaagaagcaagcagattcaagattgattttgatggaagagtcattagggtttgatgccagtttggagttgagctaggacagagacagaaatcaattatggcactaaggttctcagtcaagggaacaggaaggatggaggccctttaactgagataagaaaaacagtgatggaatgggttgtatagacgtgtgtgaagttcaggggcaatatcaaggctggagatataatcacagaatgagtaacatttcgttcatattacaagtcatgagactggattggatccacaggataatgaatgtagagatagcaaaccagccccagaacgaagccccaggcaatcctacatttagacgaggaaaagccagcaagggagccagtaaggagtgatgttgaggcaggaggggtgcagcaacacgtagagacaactgcagaaagtgtatcaggaaagaggcggtgagcagctattccaatcctacggactggacaaataagaagaggacaaagaattgagcattatgtctgtcaatgtggaggtcatgaatgtctttacaggggccatttccaggaaaatgtggagggacaagagtaggaaaaaaggaattgaaaacagcgagtacccaatgattgacaagtattgtaaggagttttgttgtgaaggagaacagagaagctggggttgggggtggtagggatatgagaggacaagatagaagtatttttaaaatatgagataaattccagccctgtaacatgtttgtatgctaatgagccagtaacgtgggaaaaattggtgatgcaggagggagagacacagatgtaggtaggtgggagaggcgatggcagagcttggaaaagtgctcttctgatggcttctattttcccagtgacacagaaagccaagccaccagttgggagttggggtgagggatgtcagtggtttgaggagagaaggcttgaaatagtcgtcttctgggagccaagagagtggatgttctgtggaactgtagcgtgatttctgggctgcatggagggcccacttgagggttgatggtcattattttaaagtgaaactactcaacatatgtgcatggctttctccaaccatattcaattgttcttgtggatatttagagtaggtagagttggatttcatcagggttggggttttgccagatgagtacagggatataatggagggacacagtagttttatgtggattcaagggagaaatgataatgattgaccatggattttaggctgggtaaggagggagataaggacagaatcagggtttggtgaaggagagtgaaatcaacagtagaatctttggtttgagggtccccacaggggtcagaggactgtcataatactaaaaggagtgagccggtggttggagagctggatacatgaaatggaggttctggagagatggtggttatagatgtcaaccaggtcttaggatgagtgtagaaggaagtggctgaggtagagaacagggcaaaagcaccactggagagtaggtcaagggagtaggagatcagagtagaattacctatgcagatattgaaattaccaagaactttgccatcctcccacccacacacaccctggatcccaacctacacataagcacgtacttattctttttacttttatctcctctgactgtgtgttttcaaatagcctatcttcaagctcactatttctttcttctgcttgatcaattgtgctattaaagagcaatgatgcattctctggtatgccagttgcattttttagctccagattttctgcttgattcttttaaattatttcaatctcttaaagtctatctggtaggattccgaattccttctctgtgttatcttgaatttgagtttcctcaaaacagttattttgaattttcaatctgaaaagtcacatatctctgtccctctgggattgatccctggtgccttatttagttcatttggtgaagtcatgttttcctggaaggtcttgatgcttatggatgttagtcagtgtctgggcattgaagagttaagtatttattctagtctttgcaatctgggcttgtttgtacccacccttcttgggaaggctttccaggtattcaaagggatttgggtgttatgatctaagtgtttggttactgcagccatatctgcatcagggggcacctcaagcccagtaacactgtggctctttcagacttgtaaacgtaccaccttggtggtcttgggtaagatccaaaagaattatctggataaccaggcagagactcttgttttctttccttaatttctcccaaagatatgaagtctctctctctctttctctctctctctctctctgtgtgtgtgtgggtgggggggagatatgtatctgtgctgagctgcctggaactgggggagagatgacataagcacccttgtgaccaccacaattgggactgcactggatcacacctgaagccagaatggcactggtgcctcactcaaggcttgtgataaccactgtctgtctactgcctatgtttgctcaaagccctaggactctgcaatcagcaggtggtgaagccagccaggcttgtatccttcccttcagggcagcaagtccccactgtcccaggtgggtccagagatgccatcagagagccagggcctggactcagaaactttaggaatctacctggtgctctattctactgtggatgagctggcacccaagccacaagacaaagtccttcccattcttgcctcctctttccccaagcagaggtcatgccttccccacggctaccaccacccaaggcccacgacaagtacagtctggctaccactgatgttccttcaaggcccaagggctgtttaatcatctgatgttgaatactgccaggcctgggactctcccttcagggcagtgggctcccctctggctcagggcaggtccagaaatgctgtccaacaactaaggcctgaaattggtaatctcatgagcctccttggtgctctaccccactgtggctgagttggtacataagctgcaaaacaaagtcccctttactcttccctctccttttctcaagcaaaagtagtccctcctcatagtcaccacagctggggatgttctgggtcacacctgcagccagcatggtactgtgttttgccaaagttctgtggtgactgctgcctggctgttgttgatgtttattcaaggaccaagggctatttagtcagaagctgttgaattctgccaggactgggtccttcctttcagggcagtgggttcccttctagcccagggtgggtctagaaatgttgtccaggagctatggcccacaggggcttcaggactctgcttggtactttaatttgctgtggctgagctggtataccagtttcaagacaaagtcctctttactcttccctctcctcctggagctgcaagctgtgctgcctgaggttagtggagggatgacataagcactccttaggccacatcagctggcatctcactaggtcatgtgcactccaagttcactgattctgggcctggttcagcaccaggccttgcccaggaattgcagtccttgtggcctagactgcctttcaagtttatttagaaccccagagcatcttagcccagagtagtggggcttgccagaactcaggttctaactgttgggatgggttattcccctctggctagggctggtctaaatgctccttacataggtgccagctgagctgtgcctggtgttgctttccacttgacaaggcagcactgagtttcaatgtaaaatctcacaatcactgcactctccctccaccaggttcagagattctttctccatgccagactattggccactgccaggggatgggagagaagtggcattggtgactcaagactgtctttcctaccctcttcagtgcctctttcagtgatatcaagttaaaactaggaacagtaattactcacctgatttttggttcttatcaaaccaggaactgtgattgctcacctgattttcagttattatgaaggtgcttcttttgtgtggacagttgttcaattcagtgttcctgcagagaggacgatcagtagagttttctatttggccatcttgctttgcctctggattgcagttttaaactagttggtcagggaaggactcactgagaagtaacattcgagaagcatttaaaggaataagggtgatagctgcgtagataactgggagaagagtattcttgtaaaaggaaatggtatgtgcaaaggccctgggacaaaagtgtggttggcatgtatgaggcacaaggagtggagggaaagatttcacacaggccagaggcaaggctcaaccacagtctgagtccagtcttggcggagtgcctgatgatcctcccaggaatgtcagaagatgggaagtcctgtgaggagctgccacaagacccttttccactctcctttctattatgcaaggctaccatgaggcaattcttcacccacttccctggttctagtgagggatgggactttccacctagccccctgctttgatctgaatatttatgtccctcagaaaattcatatgttgaaacctgattaacaatgtgatgtgatagtactaagaggtgggactttaagggatgatcaggccatgaaaacagagccatccgaagacagccctcaccagacactgaatctgctggtgccttgatcttgggttttccagcccccagaactgtgagcaataaatttctgctgtgtataagttacccagtctaaggtgttttgttatagcagcccaaatggactaagacacctccctccctaccttagagtatagtttttagtatgtggtattggctccttagcaacagagcacccacctcttgtgttgcccataatctgatctttggtttggcactgtcctgtggaactagggacacaggaatctgacagaagctcagtgtgtctacatcaaatatcaccataaaagagtggtaggagattagctcagatgattcgcccttaaattttccatagctggctccctcttgccttttagctttttgctctaatgtcacaacctcaaagaagccttcccagatatactctgcaaatagctcatccccttctacattgtatctcagctcctgttttctttcctccagagcatttgccctctgacatttttctgattcactcctatttccttgtgatcggtctgtctttcccaccagattattggtctcatgaggtcagggacatttctgtcttgtacatttctgtaacctcagctccctcctgcctttctcatatcattccacaccatgtagcataggaattatacatgtatctttttgttctgattctaaaaataatatgttctcatggtggcaattttgaaaatgaccactcacaattccaccagccagagaaagccattattaaaatgtttacatatcaccttcttatttttcactctacaaattcaattttacatcatttagttcatacactgtaaaaagttttttaatttcctttgtttttttaatctaattatacaattcataaaatatacattataaaatattcaggcaaaacacaaatacatgaaatagaaagttaaaattcacccataatcccctgatctgttgagaatcactttagtactttcctatttatccttctgtatgttttctacccttctgtatgttttctttcacgtacatttttttttcacacacacaaaggaattatgaactgcctttttgcccttaacaatatcttgagatctcatgggcatctctgtcaaggcagtacagagtatggctgaactaatacttctttacctatttcctttttttttttattattattgtagacaatgctgttatggccctgcttgtacatgcgtcttggacatttgaccattttctccctttgctttcatgctttggttttctccacttccaacacttaaaatatttgttattttcacctacctttttatgttttcattagataatgtgtaaatttttaatccctgtatgaaattgaatttggcttaagatttaagctagggattaactgtatttttctaagtgtttattctgtttgggaactgttatttctccaccactgttggagagaaggggtagcttaggagacttaatatccattaaccaccctctcagtgtctctttcatatggacaattaatatttcctcagcctttaagaatcttctcccctccctactgaccagagagccaccattcagatgtgtctttaaagctattttggagccacaattcttccacactgatggaagcactagttttaccaggtgtttcttttttgttgaaaccagtgtaactttagcacaacttttattatctagtggatcaattaccttctctcctcttgtccctaatcatttctgcttctttccctccaattttcttgttcatttttgcttatttattctgttatctaacccctagaatagtttcataaagttacaaaagaagaaataccattgatatcttggttgcaattgtattaaatttttggattaaaattgggaaaactggtatctttacaatataaatcttttcaatcaatctcttggtgttaatattttcatttatcttgtttaatattcctaggtaagttttctagttttcttcttatagattagatgctgcacattttaaaatattttacgcatagttgttttatatatatatatttgttgcaattgtgatttccattacagttgccaacttgttattgctagtttgtgagaaagatgctgatttttgtaaaattacctgtatccatcagctttgcttaaaaatgtttcttagttaaacatgtttagttttctaaacgatgagcatacaatttgcaaataacgatgaatgtgtctcctccacctcagtatgtatgctatttgtttcttgacataatcttactacaagatcctgtccctagctttcagggcaatgcctcttgtgattcgatttacaccaacatttaccattggttatgatacactgaatgcatcatattgagaaagaatcatttgattcctctttcactactatttatcattttaatcagaaatagaagttaaattttattaaatgacttttgtttatttgcagtatttttaatggatgtaaagtattccattttatggaggtttcaaaatttatctaagaattcctcaggtaattggaggctcatgctgtttctactgtttattactgtaattgatgctgaaaatgaatatctttttataaatatttacccactcttaaaagtagaattatagatctctagcaataaaattacgggtttaaagaatatgagcctttaagaggctttactctgtagatctgatttgctatacaacaaggttgtaccacatcccagtgcataaaagtgttcatttcacttcacccttgccagcaggaaatatcgcaatttaatagtccttgcaaaatttattaatatttcattatttagtttgcatttttagtcaagcttatattctctcatgttcattcaccattttccttttattttctgtgcattaactgtgtggcctcatttttctgttgcaatcttagtgtttttaaattaattctcatatgttctttgcacattatatagcacatatttatgctttggtttgcctcttattggtgctaatatgtttgacatgcagaagtttactattttaatgtagatcaatctattgctttgtttttcctttgtgattctttccatttcttttaaacgtagaaagccccatccacccatccacctatccatacagggatcagaaagataattcacgcacttcgtttcttagttttcttgtggttttagagttagaggaaacaggaaatccagaggcccacaggtgtggcagaccatctagcgaggtggggtttataaggtttccatagctccttggcctttgccatggctgcttcctctccctgtaatgtgcaccccgcttctctacctggcaacatccatttagagttgagatccggtagaaacctgtgctgacactcccctttcatctaggaatggtcttgttgtcatgttttacctccactcaacaagccattacatgcttctattaaagcatcttcatttatttccttctttttttttcaatagacatctaatgactgcccaccttgttgcttgaactcaatcactgtccccactttatgatacttgtagttcagaggggagagcaaaagccacacagtctactcattcaatctgtttcactgcatgtattcacttacctattagacacaacaacatataagtacagattaagatgttaagatgtgctgtgttgttaggagcacttatgacaaggaaggggatcttacttaaaacaaggaaggggatcttacttaaagtgatgtagtaagatttggacaagaaacaagatgcaaacctattagaaatgccccactataaaaatgtattattacttacaaattatatgattagctgcttagaaagctaaagatgattaactaagaactgtgtttagcaagacagatggaatcaagccaattttacaaaattcagcccctttcctacaaatcaacaataaccagttaggaaataagatgagaaaaaaatccatttttggatctcacaattgcaacttcccctttgaagaagtgacaattaagctgatacctaaagggaaagagtcagtcatgtgacgtgagtttgaggctcgatgtccagaaagggggccagtgtggctgggacgtagtgagcaagggtgggggtagtaagaggagatggtttggagaggggccctagagaacttttcaaggggttgaccctctttctgataataatgtaatgcactggagagttttaagcaagagaatgacatgatcagctttatactttgtaaagatcactgtgatattgtgtggggaatgcacatgtgacagatgatcatgggagttttggggatgggaagcaatagagggattccagatggattttggaggcacagccaacaaaatgtggacattaattggatatttggagtcgaacaaaaagatgtagttaaggatgatcccagtagtattagtttgctagggccacctaagaaagtaccacaaactaggtggctgcattagtcagcttaagctgccacatccaggtaccatagactaggtgatgtaaacaacaagcatccatttttctcacagttctggtggctaaaagtctaccatcaaggtgcctgcaaatttggttcttggtgagggctctcttcctggcttgcagatggctgccttcttgctgtgtcctcatatggcctttcctctgtgcatgtgtggagagagagagagagagagacttcttaaaaggacacaagctgaacttgttgggtatactgggaagacaagatgaggagacaatacatgcagacaagtgccttgaacacaggcagagaaatgtgacacttactggagagggatgtgggagtcaaggattggttttttgtaaagacagaaaatatcgcaagtttctatggtgatgggactggtcaagtagaaagggggattcattgatggtggagggaggggcaagtggcatgggatgggatccagaacacaaatgaagacatcagccttagaaaggagaagggatacttctgccattttagcttgcagaaagctgagttcagtcagaggaaagcatacgaaggattagtgatgggaggatgagggaatttctattccatatcttgtaacatctaaattgagtattaacaaagaaagcaagagggaaatggaaagacatggggagtttgaggaaagggcgaatcaccattctgagaaccggactggaaagacaccaaacacggaagtcctgagcagcgagatgtgccttggtgaggctgaagatcatgagcctacagcggtacacaatctgccaatgtgtgtgattttctctagaagcacggaggtgcataagtgcagacacacagagggcatagttgagttcatccaagggtgggaatttgtcagtcaattgtgacagaagcaaaaaagagaaagaagatgattatatgatggatcatggccttggggtgcttgaggagaatagagaaggaagattcatcagaaagttgaccaagggctggactgaaaccttgagaacagaattctgtatggcttagggcctgacctggaataggtagtcagaaaatgttaaccgaattggtcacaagggaggaccctggaaagctgcaatactgtgaccatgcaccagggggcaagagatgacaagaaatgagtttgaccacacccaacctagggcttgagggctgtgtgtcctgagcgccactggcctacctgactgctcctagggctttggggtgcatgatgctgcctacctgagctggagcctgctgtatctaccaccaaattggtggcggtggggtgtgtggggcaaggacagatgaaaccatgaatctaagacacagataaaggaacttccttcgtttccacccatcctgtgctcttgtccatgtctaggcgctgggcaatgccccagccctcggcaaccccaggaagctgactctgagtgttataggggcaccctgagatatggtaccaagaatcacaatctatgtgctggccctgaagagccatcgaacatctttcccaaggctggtaccataggttatagtcttaggggctggccctaacctagagggttcctagagctaagagccctgagcctggaaaaagtgtccgtgcctaaggaggagcatgggaaggctctggtggagagaacccttgaccaccagatctcccctgatgcctcctgtaagcccagcccatgctgagcctgggaacagaagagaatagagactggacagtcatctgttcatttatttacttcctcattaattcacactttcatgttcccttccccgtgttagtggaagaaacagacaattatgtctaaggtgatagatggaagaaagggaggattcaggcagagtctgcgtgttagcttgggtgactcagaggatggaggtgcctatccaaaagaggaggcagtgcaggagttaaaggaggggaacagtgtgctgataaagaccagaagagaagacgcaactggcctgagaagagagagggggaggtgaatgcaataagggtggagatgcactctgtggtatggccatcttccaggaacccacgttgtctcttcatcagagctgagatggagaacataaggctcagaatggcagggagacaggctgacatttgttctctcactcattcattggttccttgatccaggagggcctctggattctagtctcactctcaagcaagtgtcttatctttgtccctatgttccagtgagtcagcagagacagggagcggtaaagtgatttgcccagagtttcacagtaggtgggtagcaggtagaagcctaaacattcaatgccttgcctctattggcaccatatcccacatggaaactggtgggcactgcctactgacaagtgaggggaacaataaaagagcagcactgaactcagttcaagacccccatcttgagtcttctgctgtcccattacccctttcgcaagcagtcctaggttgcctttcctagcagacagcatgtccaaggtttggggtgtaaatggcctcaagagcatggctcttacctagagccctgagcctctttctgtgctgaagtccgccccactcctagtcagccaaatttccagcccctctcctaactactttgcccacatggtagaactggaaatagattgcacaaacacttgactgcaccattctaaatactgcaatttgtctgtcctgtctgccgacctttgcctctctgtaattgacatgttttgattctgcagggttgtgggttttgtttcatcaacaaggtgaccaggtggttaattagcctttgacctttggggtcagggcctccatctgggcaggaaacatccatggctccaggagttttgggcctcttggcatttaattgtcaccgtcaattccccctacacttccccacagcccccatctccctgcagtggtcctgacttccgtgtgccacaaagagatttgcagaggctaactggagccaccactagggatgctcaccaacttgtgtgcagtgctttgcacttcatgacttacaccctgctgtctcatctaccaagttcccttgtgcccccagacccacaggaaagttgtagtcccagggccagaactgcacccccactgcagggcatgcccgcaggtctgacagtccctcatcgaggagctcctccctgaggaagagctgcaaggtttctggttaatgttcagaagcttaagaagggctctacctaaataatgagcactggaggaaggctttcctggggcctgggagctgcgaacattcatagaggaaacgcttacctgcaaggtactgtgttacgggggcatccaagatctgtcccaatctctgcccactgtagctcagtctagaagggcaatgacatgtgtactccaagtgaggtagaggcgggggtaggggtacatggagcagggctccttcccagccaggctttgcatggtggtgggcaagggttgaaaatatagagctgggaggcaagggcataagataatacggaatagtgacaaatgtagaagggcaaaaaggcccaggacttctatgaaacccaagggctcgggggactgggggcagagtgcatgactggaggagataaatgcagctgcagaggaagggcgaggccaggccaggtggagaatctggattctatttgataggcgatggagaagcactcgatgctgtcttccctacccattaaaataaaccaaacaaaaatcccaattatttaatatcccctagggaatatttaatttggtcctagctgtaaaccagagtcttcgttaaggttgatgtggcccattttaagagatgcaggtgaagtttactgcagtctccattgaggctagagacgcattccaaggccttggaggaccagctccctcctttcacctcataggcagtttggcctgaagctgcagttcccagttcccacgtctgcccggcccacttcctgtcactccagcccttcttccccaacctttccttcccggtgattttggcagagatgaacaaaagtcatacccaagaacattctatagctaccttccttttcattgtctccaaaatacgcgtcaaaacacactaaagacaccacagtgggcatcagcccatgctgtggtgtgtgctgcaaacatggactggagctggtagttttaataactcttccttctttattagaaaatgtgcttgggaataggaacatttatgaatgtttgatgtgtttagaaaacatgaatattcagctttaagtctgtgcatgcaatgttctattatgtacatacagactgagcgctgctcagtgaggactgctgtactgcccacctgggaatgaactgatgtggaggtcgcggtggctgtttctggaagctctgccatgtgtggtggcttgatctggaaacccaagatcaagtctttggcaaggtaggttctgtcctggagcctcttcccttggtttgcaggcagccacaatcttgctgtgtgctcacaggacctcttgtgtgtgtgtgtgtgtgcgtgcgtacgtgtgtgcgtgcatgcgcccatgtgcacgtgaaggggcttcctggtgtttcttcttttaagggcactaatcccgtcatgacagtctcaccctagtgacctcatctaaccttaatcacccctgtcaaaggcatcatcttccaacactccgacactgggcagttacagcttcaatatatgaatttggggtggggcacaaacattcagtccataaaaccatggtagagatcacgcttcctaaagaatctctggcttctcctgtgatgtgaggcctaatgtgcctcctttattttaacttgccactagagactggggtctcctttgctttctccaaccaatggctcattaccttaagaaaggcacacaatgacctctggtttggctatccgaacctctctctgcaccatgcagacaactgtgaagatgtccttcttggtgcttgacttgtaaccaaaattattttccctctagggggtactcctatctattaaaaagtctactgatgggagagaaagaacccacatgtaaaaggtatgggtacactgccctttagtgttcaggcttacttctgaagtaatatgtgaggcacaaacaccatccaccctgagaaggtagcccctaggccaactgtttcagagttcagtgggcctgtggctgcccttggtgtcaatgaaggagccagcatgcctgagctacacgaaaaaaagctacacagcgggcctgggcacacggccatgtgggaaggcagcagtcgctggcctctgcaaatgtggcatggagctgaggtgtgaacaagagactgaggggagcagggtctacaaaaggggcctaactgtagggaaccaacccttcaccagggaccttggcacagtcaggttccaaacgtcactcatcaattcacaaagttgcagtgaacgaaaatgtttattaagcaaggaagccataattattttagctctgaagtgcctccattgagttgatttcaggttcccttagttggagtcccattctctctgggcttctccaacaagactatggaggggaggcaggttgatcatcagggtcaagacctcggaattcttgtggctaagacaaaacaaccctctagatttactagattgaaaagcactttggcatttttttttctttattctttatgttgaaaactttgagcagactcttggcaggccaccttcctgtggtagaacatggatatgcaaagctgggcggggcagacaagacatcagatccagctgtggctggctgctgtcacaccctagcatactacggatcacaggctgcctctacagcataacttccaagaaacaggctgtgcttaacaaacaattacaaacataacctatcaggaaacaaataagtctctacccactaaaccctaccccaagggactttacgcaccttgaaggtcccctggccatgcagacctcattggcctgccccctccccccatttcccctcatcactggtcatgaaagtactgttagcacggcttatttgagtcacgttgctctgcaggcatcaatctggtctgctccgcagatctcatctggtctggctggtatgcagcagggccttggaaagcctgtggatcaggaggtccctcgactcctacctcagaaacttgcacctgccaggaaaaagtgaaacaaggtggaatgtttgctagagtctgtgggcccattttttggtggtaggaggaatcctttagttcaaatacacaagctgctgagaaatacttctttggaacatgagcctgcaaggtgatgggagacggaggagctacagaagataaggttcctctcctcttctctctcccagcagcatcttagcttaaagagcagcagaagcagacctgggctttctcaaagttgtcttaaggctcctgggtctgtgtctggccctctcttgtccagcttctctgccagccatggccggccaaggccactagccttgggtcttgggctcagtcatttccatgctgactgatttgcagctacttggcccactttaacaaagtgacaggagacgtaccaacccacactggggtgtggaggagggagaaggaatagatacaaagatggtgttacaaagtatgggctgagggggtgttttctggttaaggaggagggattccttgggttatgttgcaaagtgatgcaaggtttcaaggactggaacccaagggggcggagaagacacagggagcaaaaggagcagggctgggctctggacagacagctggaggtgtctggggacctgcaggcagaaaggtgccagaaggcagtagggataagccagggcaggcagtgagggctgggaagctaagaagaggagctcgggtttcatcctgaggatagcagggagcccctgaggttttgtggacaggaaagctccgacttggtcctgccctgctttctcccagctgagcaacctttcagaatctgacctttcccacttccctgggcaacgtgctcagccttgtgctggcttggtctctcaggaccccctctaggagggaaagtgcctcaaaaataggcgtgaaagatgttctcaacaaagtctggcttggtaatggaaccataggaaccataggacctattgcccactctgatctctccgtgtgagcagtccctctaagtgaccaagtttctagcagtactggtggcacagttagtcaaggggtatatgtgaaaataatcatacatttgcttgcctcaagtatttaaactcctttctgccttagcttactgtttgttctggttattttggtttggttttgttgtttgaaaaaaaaaaggttaggctataataagatttttaaagctagagtgaaaacaccttttgtaagttccattcattagtgaaattgtgtgtggggggcctgcggggagcaaaacctgctacgtaactgccatctggaccagcttccatcctggaaacatggccactgcagataatccacaaggtaggcctgcccttccaaatacggggtaccccatagatggataccaagcacattcaacagaggggccctaagtttatttttagtacaaggaaacatacctacactaggtcttagattttgtagcagaactaaagatccataagtctgaaaggaggcttgggaccagacgatgagctcagattaaaaacatggcatggctcactttgcccatgtaacatagttttgagagaagtttcagtcagattgcgtctaaggttcactaggccagctcacttttttgaggaaccctgtagagaatatttttactcagcaatgagtgctaccatcatgtgactaactgccgtcaaatgtactgagctttgaagtctggctctcacacacagcatgcacttggggtgtgtgccttatgtggaaggggcccagaatccctcttgacctgcgctggaaggaaaaggagggggctgtcccatacctgatggtaggtgggttggccgtgcagggtgccctgctcatcgcaagaccaagtgttcacttggacaacaggaccgagtgaatcagacaactcttgccaaagccggatgtaatcctgtggggtctccagggtgcttatggttgagtctgaagttatgggaaactgaggaatgctggaagaagaaattgcctcagagtttgaggtatctatcaatggcagctggttcacggggggcccttgatacgcctcaggataaaaactgtaagagaagaaagctgttgcagtgatgtggatctggacatgataactgatgagacactcacgtggtcatcagtaggtgcttcaggcacatttggttttggtggctacaccacaggattcacttgtttgtattctcactttggcctgactaagattcaacttgtcaaagtaatgtgaatgtagacactgagagaaattacaatcccttgtctcacctggttttatttatattacttggacagtcttgttcctgctacaactatgctctctgtggccttggaaagtcatttcacctactttgaaagcactcagggagctaatggctgagcagagactgtaaggcagatttccaaactccaaatccagtgctctctccacaaccctaagcctggaagtcttgtgatcaatacagatttttgaaccccatcccagactctgaatctatactttccaaaccctcctcaggtggattctgatgatcaggtcaagtggacaatatggccctaaagcagtcttcatgtcaaagtcactgattcgaaagcaaggcccagaaggaagtccagagagctttaggaggcccgtctcagaaagctaacattcattcaaaactatttagtgggccccaactatgtgctaagcaatcctttcattgctgagaagaaccttatctttctagcatttggaactgaagaccttattattgagcagaaatgtgttcatgtccctatattgccactcaggacttagccttcatgtgttcttggctgatcttagcaatctagcagttgtttcacactcacttccctcttactgttcataaatgccagggagatacctgcacttggcctactgccatcaccagattccaggaaagttggggaatgaaactggaagcccagaagtctttcagctatgggcacaagacttgtccatagacaccctgtgcaagagactgggcttggggaatccagccaagtgatttcaaggtttgtgggctaattccctagcattgaggcttccttatctagtcctttcttcatgggtacccctttgttccatcaatggatgctcatccatgcaccacacatgcagaaggatgatggccgtggccacagagaaggcaagttgagagcaagttgctattgatgagagggacgctggtgccacatggataggtcgtctgtctgtgatctcaggcatgggatccagccatgagggaaaagcaataatcatagccactatcaccattccatgcatgtcttacctttgactctcatcttcctgttgcccacagttttcatcttgatagaagccagagggctgttgttcagctgctctctggacaggaacaatgggttgggcctgtaaaaatctaacagggtgattgcagaggggcacagatacgtcacgtgggttttgcaggcatatctgcaccctctcattccccacgatgacattatgcttcagtggctgctcttgcagctgctgcttctgctgctcctcctctggctctttctgtagcatctgcccctgccacttcttccgctcctgtagcttcttcttcttttgccgcctctgctcctgcagcttcttcttctcctgcattttctgctcctgcagcttcttcttctcctgcatcttcttctgcttctgcaccttcctttgctctctcagctgttgcagctgctcccgcagctgccgctgctgctccttcaggtgttgttcttgctgcaccagttgctgctgcatcgaaaggcaacagataaaagcaccctggtgtctgcaagagcctcccagaaacttatttaacactcccattcaattctcgcaaagcaaaaggtgacaacagttgagcctctctgcacatagtgatctgtgtgactgtctactttagttagactggatactagctgcagccatgcacctggcagcgagagtctgctaatccagcacatatgtacatgtatgtatacatggtctagcatgtgcattcaggtctaggtagcccaggattttttactatcttgggcaaataaattgcagccaagtggatagtcactaccccctaaggagaaccaagtgagtcaaagtcctcaagaaaacaaaatcccctttcagatacacagttaaaacagcctttccatacctggttgaaggcaacacaaggctcctgaagctccccagtgtttttgagagagttggataaagataaaccacagaaacacttgacgtccttgggatgtgggagaggccgcttcacttgcccagcgtgttgtttctgttgtttcttgggcactgcctccgaagattggagatcaggaatgacaacgtggcgtaatgtgtttggctgcttctgtaaggacacagtatcacaaaggtcttattcacagtccacacctttccttaaggcataagacaagctgggcatggagcaggactgcccacaggcaagcctacaggaagccttggctatatataagccacatctaccattgccaaggcctggctgggccaatctcagctcttgtagccaggagaaaaagggcaaaactctaagtccctgctggagatcacattagatatcccatatcaccctgtgggcagcagctgtcactaccggcagacaccattgactaactccttaaggcttgccaaggtccctctctcctcttccttctgctactaatatagaactggtctctgacctgaaacctagcatcctgactgacctgaaggtgatccatcatcaattccaatgcattctgctggttttggatggcatcatgcagcaaccaagtcctctcttctagctgctccttcaacttcttcatcagttccagttcctggctaatgatgtcatatgcaactggtgatgatggctgtaatggctgtggggaggaattacttatggttcatgtatagcaacactggtttctccaagtcttaccatcctgtttcacttcaaaatttctgaaagactgagaatgcaaatggtagctctcaaatcctgatttcattcattactagaaagtttgaaaaaatggttagagaatttaggaattctagataagaaatggaccacggagatcatttagcctgattcttttcccaaaaagaaagaagtggaattggcccagagacatgaagcaacatgcccaaagtccttagtggaagagtcatgggccagtgccaaagtattctgcgcctgggtcaaatcacaaatggcagtccaccaatagggcccctgttagcaatgcaataatgaaaaccatcaactggcacttcctttgttccaggcactcttctaagcactgtacgaaaactcacaggtctgatcttcacagagccctgaaaagcaggtactattattgttctcatatagtacttagatggactctcctctaggtcctggaaatctaattttaacttggataacagcttcacatctggaaagaagcaaatgtacaggtttataaaagtagagagtgtgctatggggcaaatgatgctccaaattagctggaatagaaggaataaggcaggtcacacgtagaggagaaaccagagttttgtacaggttcaggcagccgaggaacttggattttattcatcagtcacctggcactgctgctagaagatgtgttctacaacccagatcttatcagggatgtaagatgctcagaactcagttataaaacatgccttctggcagctgtgcagaagatcaagtggtgggagaaacgaagcgtggagtttgggaaaagtcaattagaaggctgtgggagtaattcaggatagagataataggggcatggaacaatccagaggtagacgatatagagacacatttgagagaaattaagaaaataacaaatgctggtgaggatgtggaaaaagaagaacgctcatacactgttggtaagaatgtaaattagtacagccactatggaaaacagtatggaggttccttatagaacgaaaaatacaactaccgtatgatccagcaaatcccactgctgagtatacaccagaagaaaggaaatcagtagatcaaaaaggtatctgcactcccatgttcgttgcagtactattcacaatagccaaaatttggaattaacccaagtattcatcaacagacaaatggctaaagaaaatgtgttatatatacagaatagaatattattcagccataaaaataataaattcacatcacctgcagcaacatggatggaactggaggtcattatgttaagtgaaataagccaggtacagaaagacaaatatcacatgttctcactcatatgtgaaagttaaaaatgttgatatcatggaggtggagagtagaatggtggttaccagaggctaggaagggaatggggaagagggggatgaagagaagttgattactgggtaccaaaatacagttaaacgttaggaacaagttctagtactcaagtaggaaaattagagttaaaacaatctattgtatattttaaaatagctaaaagaattgtaatgctcccaacacaaagaaaaaacaaatatttgaagtgatgggtatcctgattaccctgacttgatcattacacattgtgtatatgtatccaaatatatacatgtatccaaaactatgtacaacataatatatatagtgtatatatatacactatacatagtatatatataatatgaaaaccatcaattggcactaaactatgtatactatatagtgtatatatatatatatatacacacacacatatagtatatataatatgtacaactgcaatatatcaaaaataaacaaaattctaagaaaaagattaacatccacaatatcttaaagtaaaataaagtttaaaaaacagtaataaaaaagaggctgagctgggtgtggtggcttgcatctgtaatcccaggtactcaggaggctgacgtgggagaactgcttgaggcttgagaccagcctgggcaacaaagcaaaaaccccatctctgaaaaaaaaaaaaatctcttttttttttgttgtgtctctgccaggctttggtatcaggatgatgctggcctcataaaacgagttaggtaggattccctctttttctattgattggaatagtttcagaacgaatggtaccagctcctccttgtacctctggtagaattcagctgtgaatccatctggtcctggactttttttggttggtaagctattaattattgcctcaatttcagaggctgttattggtctattcagagattcagcttcttcctggtttagtcttgggagggtgcatgtgttgaggaatttatccatttcttctagattttctagtttatttgcgtagaggtgtttatagtattctctgatggtagtttgtatttctgtgggattggcggtgatatcccctttatcattttttattgcgtctatttgattcttctctcttttcttctttattagtcttgctagcggtctatcaattttgttgatcttttcaaaaatcctcaataaaatactggcaaaccgaatccagcagcacatcaaaaagcttatccactatgatcaagtgggcttcatccctgggatgcaaggctggttcaacatatgcaaatcaataaacgtaatccagcatataaacagaaccaatgacaaaaaccatacgattatctcagttgatgcagaaaagatctttgacaaaattcaacaacccttcatgctaaaaactctcagtaaattaggtatcgatgggacgtatctcaaaatgataacagctatctatgacaagcgcacagccaatatcatactgaatgggcaaaaactggaagcattccctttgaaaactggcacaagacagggatgccgtctctcaccactcctattcaacatagtgttgcaagttctggccagggcaatcaggtatgagaaagaatcaatatcgtgaaaatggccacactgcccaaggtaatttatagattcaatgccgtccccatcaagctaccaatggctttcttcacagaatcggaaaaaactactttaaagttcatatggaaccaaaaaagagcctgcattgccaagtcaatcttaagtcaaaagaacaaagctggtggcatcatgctacctgacttcaaactataccacaaggctacagtaaccaaaacagcatggtactggtaccaaaacagagatacagaccaatggaacagaacagagccctcagaaataatgccacatatctacaaccatcttatctttgacaaatctgacaaaaacaagaaacggggaaaggattccctatttaacaaatggtgctgggaaaactggctagccatatgtagaaagctgaaactggatcccttccttacaccttatacaaaaattaattcaagatggattaaagacttaaatgttagacgtaaaaccacaaagccatagaagaaaacctaggcaataccattcaggacataggcgtgggcaaggacttcatgtctaaaacaccgaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaacggctaataaccagaatctacaatgaactcaaacaaattgacaagaaacaaacaaccccatcaacaagtgggcgaaggatatgaacagacacttctcaaaagaagacatttatgcagccaaaagacacatgaaaaaatgctcagcatcactggccatcagagaaatgcaaatcaaaaccacaatgagataccatctcacaccagttagaataaaaatcattaaaaagtcaggaaacaacaaatgctagagaggatgtggagaaataggaacacttttacactgttggtgggactgtaaactagttcaaccattgtggaagaaagtgtggcaattcctcaaggatctagaactagaaataccatttgacccagccatcccattactgggtatatacccaaaggattataaatcatgctgctataaagacacatgcacacggatgtttattgtggcactattcacaatagcaaagactaggaaccaacccaaatgtccatcagtgatatactggattaagaaaatgtggcccatatacaccagggaatactatgcagccataaaaaatgatgagttcatgtcctttgtagggacatggatgaagctggaaaccatcattctcagcatactatcacaaggacaaaaaaccaaacaccgcatgttctcactcataggtgggaattgaacaatgagaacacttggacacaggaaggggaacatcacacaccagggcctgtcatggggtggggggagtggggagggatagcattaggagatatacctaatgttaaatgatgagttaataggtgcagcacaccaacatggtacatgtatacgtatgaaacaaacctacacgttgtgcacatgtaccctaaatcttaaagtataattaaaaaaaaaaggagaaaaaaaaaggtggatgagacttctcaactgattggccgagagggacagaaaagagatgagattcttggaaaataattatctttcaaggctggaagtcgggcctgggaacaattgctatttgccctgaactatgctggataccatgcatataaacaaggtcagagagccacagtcctgatcgataaagaatttacaacattaatgataagaaaaaggtacctacacttgcaactttcagaaaccaaaaatagacttatactgtggttcatcaataccctttatgagtaatgtaagtacatagatgagttgagagagagagagagaataccctacaagttgttgttttcattatttggaataaaaattatatatgtatttttagtccattgaaaattgttcaacttgtccttctttcactatgtattgtatgtctcttcctataagaaagcagacattcattagaccaaaaaaaaaaaaacacacacacacacatgcacgcgcgtgtacacacccacacagacacacacacacacccctctaaactcaggactagaagagacaaaccctacaggttatcacatcctctcaccctctccaagcagaaattttctttgcttttcctggaaaaggagctgccaagcattgactctcaccactccatcgaaggagagaggacttgctattttgagaggtgacctaatccgtctgagaagggctaatagtgtcagactgcttccttgatcctctggaaccatatcttccactttatgacccttcaactacttggataaagctgtcctgtcccttcccattcttcccttctcagtgtcttcggcaactgattaagatgttttccagccccttcctcatcctggtctccatcttctggatacactccaggttgctgatacatggcacccaggaataagcctaatacactagcacatgcagagccagatgacacacgttcattgctggttattttggtgattttttaaaagttatacttcaaaatttaattacaagttaattcaaaagagaagataaacctgtcaacagtgaaagggggaccacaactttttggcatgataaggacataaatcaggccacagcagattttcacagaaatttccttttaaatagctcaaagaattttcacagcagtctgcaaatccccgcaaggcaagaccatttcaacatggagaaactgaggctcagtaatttgccaaggccacactgctggggccaaactcaaacaattgtgttctagcccttaattattttcactggatgaggatccttttgaaccggagtcactcaatcttaggctcagtgatgaacgcacacaattccaggtaactgaccatcaactcattagcttggcttctaatcctgattttaataatcctgtctaatataaaagatgatcatcgaaatctgtggttatgtacacacatttcagggtagaggaactacacagtagttaatccaaccattttgatttggccgtggactgtacattggtactgatgtttcaaggttgggtatatctaacgactctgaaatgcatgttctaacctaataaaaattccactgggaaaacctagcttgtggtgcagggagagggttggtatgggaaggccagaaagttgtcttccctctagatggttagcatgctctcacaggtgattaaaagcagggctcttaaaaataccaccttttcttagcagctaagcttcttatttggctcaaacttttcctcaagtacaaagtgtccatgggatttcatattaagaagagcacagggatttggtcttacttagagaacctccaatctccctgtttgtgagggtccattgagttctcaacggcatctgaaaatccagtataacagaaatagtgatatagttttgaaaaagtaacaaacatactttctgtgaagtgaaactggtcacaagagtgaaaatttgggctttgcaaggttagctatccagacaaacgtgaagcgagtgaagcgagactttcagagtacctgagcacttgcgccagcagcccccaggtccactgagtcctctggatccactggatccatcaggcctgcctggtccaacggggcaactgggttctctgggtcctgctggtccattgggccctcctggtccactgagtccacctgatccaccgagaactccaggtccactgggtctgccctgtacaatggattcacctcaggctcacctcgaaagtcttgcaaggataaggctgaggaagaaagcacaggggagttcatgacttaaaaagcaaaagtactaatgttatcaaaaagactgtacgagggtcattttagcccatgttaaggatgagatgtgccaggtgccaggaatcattcagaatattattttaaaaatctgttcatatttgaaaatgaagaaaagggagagagtgtttgaagttaccactgcctaccctccagcttaagctagtgcctaaacccactgcatttgttagtgtcatttcattcattataaaattattttggctctgcttttggagatttagtaccatccaaccgataaaaccaaataaaatctagtcataaatcacttctgcacaatcgggttgcccagaatgtgggacctcgggagtgctcaaagttctctgggaggtgttatgacatgacttggtttcaacagccctgaaaagcacagtggagaacattatttgaataatgcaaaatggtacagtcatttttgaaaacattttgtcagtttctaataaagttaaacacatacttcccaaatgacccagcagtcccgcaaccaggagttgaaaacttatattcatacaacacaaaaacttctacgcaaatgtttaatgtagctttattcatgatcaaaaaacacttggaaacaatccagatgttcttttacaggtgaatgaagttttaaaacctgatatattcataagatgcagtattactcagcaataaaagggaatgaaccgttgattcatgcaaacgtggatgaatcctaaatgcattttgctaagtgaaaggggctagaccaaaaaggctagatgtcatatgattcctcttacatgacattctggaaaagggaaaccttcagaggtgaaatacagatcagtggttgtcaggggatgggagacaaaggttgagtacaaagagggagcacaaaggaattttgggggtgatggaactattctgtttggtactgtggtgatggatacatgactctcaacatttgtcaaaatccatagaactgtatatatcaaagagtgaattttactgtatataaaattgaaaagaaattgatcaggaggcaggaaaacctaggcgaaaatacagactgtaacaaatgaatctaattctattacagataaatgacatatccacagtgatgggggtgagaaataaagaagctaacgcaggaacttcagaaaacagaggtttgcctggatactgcaaagctaaagacaaaaaaaatgcacacacaaattaattccaaatggtaaatttgttccttaaggggtacaggttagcaattgtgaaactactttttatgaatgtttatgtattggaaaaatcaataaatataccatagataatgaaagccagatttctcactgtcagagatacaaattacaaataagcagacagaaaaggctagaatgaaccctatgatactgggctggagtaggaactatcaatgaactcctgttgttgttgttgttgttggttgttacatgctgaaataaatacagatggttgtatatggttgcatgggttagtatgaatagacatctttcctagtccactgagagggtttagaagtagtgacacacctgtaacaatgagtacaactagcacccagatcttcgtttctaaataccactctccaaataaaggacctaaataaggttccttaaagaaggggttgatttaaatgacaacatgtaataatggaaataaggaagtgaagggaaaaaaaaagatgcagacatgataaaaggacaagggagccaacctaaaagagccccatgagccaaagctggaacaatttttttttaatgacggtattggattgcaaaccaaataataaaaaaatgcccatggattcatcctgatgtaaatgaatgtacgaataaatgaatgaaagagagacaaggaacaactctttcttacagcaagattgcagttaataaatatacaaaaaacgagggaaataaaaaattggcattagaagtaattgctgtaggccaattccactgatgatgctaaatgtgaaggagagtttaaggagaaacagaaaacattatgtgcatgttctcaatgtagctcccctcaaatatttgataagtacaaaggggaaaacagtaccaccttaaccaagcaatcaagttaacaccaccagcaataaaacataccatcatgtatattctgatatgatgccctaaggagggcacatcacatctgtggtattcttccccaaaatgcaagacctcaatctcatcttgaaaaatcatcagacgaacccaaattgagggacattctgtcaaatacctggcccatatccttcaaaagtatcggatgataaaaaaaaaaaaaagcaagaatgagacactgtcaaagactggaagaaactaaaaacacatattatttaaattcaatgagggatcctggattagttattggaacagaaaaacaactttctgggaaaactgaataaaggctgaagctcacttaaaagtattgcatcaatgttaacttcttagttttgccagctgtactgtggttatgtaaaatgttacattaggggaagctaaatgaaggttatcctaaatggtatctttcccttatttttctatttttttctttgtgctatttttgcaactcttcaagtccaaaattatttcaagattaaaagtttggaaaagagaaacatctggattaggcagaatgaaccactccgtcacttcctatctgctttctgcagcctggggttgcataccttaccatgctatggtcatgagcgaattgtcctttaatcatagcatgagtttgggatgaccattgaaaatattttgaaaaattctggtttctggatacttccagtgtttagactgttggctaaattcttctgcttaactcttttttccactaaaagccattttccaaatcattttagcatatttttcttttttttttttgagacggagtcttgctctgtcgcccaggctggagtgcagtggcaagagctcggctcactgcaagccccgcctcccgagttcatgccattctcctgccccagcctcctgaatagctgggactacaggcgtgcctgccaccacgcccggctaattttttgtatttttagtagagacggggtttcaccgtgttagccaggatggtctcgatctcctgacctcatgatccgcccacctcggcctctcaaagtgctgggattacaggcatgagccaccgtgcccggcccagtttaccattttttaattttctgattccaagtaaacaaagctactaaattatctgtaagtgatagtgagaaacccaggagttacttgacttctaccatatcagccataagctgctagccatttcaatatgctcattttgttggaacagtcatctgtggaaggttataaggatttctccatcattggcttaacagtagtgaatacaaataattctctatagcaaagttacaatggtaggtccagataaataggtttaaagcaatcaatgctcttataaattttagaaatcacaattatgagttcatggagtttgacctctcctgccaaaaatcaattgttttggaaggaattttttaaacacagctttgagattgacagcaacaatggaaaagttgttaactaagaattttaaaagttggagatactaaaactggatttaaaaactgaaaaagagtgaaataaaaattaaaatagagcttattacttctatataaggagattccacataccaattatttatgataagattaattaggagatataatttgtattatgcatccaccatttccttaagttttgtacttttcaaacaattacggttacgaaatatctttaatattgaaactcattaaagaaatatcactgtttttgagagactctcactttccccctttattggcatgaaaactcaataacaagaggtttctttggaatccaaatactgtgtgatagcagaatagactacacgagtataaaaagataaaacgctattccttcaaggattgagatccagcgccaatttttagaagattaaaattaaataggagaaaagacttgaatctgtgatgaaatactcatttttattattctcaaatcatcatctcaaatatttacagaagatgaagaaagttggaattcactctgggatttcacagtattatagagcattatattcatttgaaaaactgtaactaccctgggggtcactgtttttcttctaatagtccctatccaaatgcataaatgtacctacctggagattcaggcatagtatccaggaaaactgtactggagcaataagttgaatcagaatctacaaacatgtgaacgttttcttgtggtccatactgctcaacctctgcaatatcaatttggtcctgtacatttccaaaagagaaagataggacattgcattttggagttagaaagaataggaaacacaggcagaatacaaactttgatgcatttcacatcacaatttctaacactgctgcaatcaactgaaaacctaacaaaaatcatcatcaaatacctccttaaaaatattgctggaagataacaagcggagattatagatgccacaaggtatacactgacaaactgaagaagagaaacacagtatacataacactaaaaataaaggcatcaaaaaatgtttatagatcaaaaggcatggcaaaaacaattctgcctttcagtggtgtcagtaggatgctgtcatgatagttgccaaggatggtagtcacctcatctcccattcctcattattagacccaaacaaactggttcacagagaaatgggacagcagtgggagacctgcaccaccactgataaggccattttcccagagttcctgcacttgcatcctaggcttagagcaagaaaaggccaaccaggggctgtttaacaactattgcatgtctttaggcagattaaagttgaaagtattattagcaaaactattttaagcagagaggtgaaaaggcctctaagagcttctagtccaatgttctcactggatagtgtcaaagagggcaaggccatacagacagacaggagcagagtgagagatagaatccattgactccaaacccaatgctctttttcctaagcctggctacctttaagccatttgttgccttaaactacatacataatatttctattgagtgatcctgtcctatttcctgaacaactgaatcctttttgaatagtctgtggatcactgtccattgaaatttaagtacctggtttagcagtgaaatattttacatccctgacaaaatattttgtttgcttttgttctggattggcttaagacacagacccatggtgatttttctacaaagaatctgtttgttggatcacatcccagcatttcaacttcaggaaactgtgcaacctcactgttcaaatgactatgttttatactccctaataagtgatatgttgctggggatgtgacaatcttttcattacttacaatgacattatggtgaatcggtattcattaagaggagatatgacctgtctctttcctcttccttctgttcttcttcatagccatctatcgatttaatcactaactctttgctttctggattattttcaacataaacttatattctcaaatgttaattaagatgtccacttttgggtattcgtatgttcgggcttatcaatataaatgcagtgagcttaaattaacttaaatgacagcatcatgtgcagtaatggtaattggcctggaaaaaacaaagccaagaaactactttggaagcaaaaagataacagtttaaaatgcaattaggactaaggtgaaaatgcatgcatggagataggaagaaaatcaacatgcttttacagttttcagtggagttttggattcacctttattccataattgtctccacgaatagtgtgctaaaggatttgaaaagagaggcatgggttttgaggctggatatagagtaggcttcaaatgcaaactccaatacctgatggttatgtaaactgcaaatatgtagggggagagggggaagagggcattcaagaagtctgttcccaaatctttgcattttccctgtggtggcttattgttaaagtgctctaatttttaggagatccttgcattttacttttttggaagtggtgggggaaaggccatagggcttccaatcaagacagcagattggacagacatggagaaaatgctacataaaatagagcagaatttaaaaaaaaaaaaaccctccaaaaaaatcagtgaatccaggagctggttttttgaaaagatcaacaaaattgatagaccgctagcaagactaataaagaagaaaagagagaagaatctaacagacgcaataaaaaatgataaaggggatatcaccaccgatcccacagaaatacaaactgccatcagagaatactataaacacctctacacaaataaactagaaaatgtagaagaaatggataaattcctggacacatacgccctcccaagactaaaccaggaagaagctgaatccctgaatagaccaataacaggctctgaaattgaggcaataattaataacctaccaaccaaacaaactccgggaccagacggactcacagtcgaattctaccagaggtacaaggaggagctggtaccattccttctgaaactattccaatcaataggaaaagagggaatcctccctaactcattttatgagcccagcatcatcctgataccaaagtctggcagagaaacaacaaaaaaaagagaattttagaccaatatccctgatgaacactgatataaaaatcctcaataaaatactggcaaacagaatctagcagcacatcaaaaagcttatccaccatcatcaagtgggcttcatcccagggatgcaaggctggttcaacatagacaaatcaataaacgtaatccagcatataaacagaaccaatgacaaaaaccacatggttatctcaatagatgcagaaaaggcctttgacaaaattcaacagcccttcatgctaaaaactctcaataaattaggtattgatgggacgtatctcaaaataataagagctatttatgacaaacccacagccaatatcatactgaatgggcaaaaaccggaggctttccctttgaaaattcgcacaagacagggatgccgtctctcaccactgctattcaacatagtgttggaagttctggccagggcaatcaggcaggagaaagaaataaatggtattcaattaggaaaagagaagtcaaattgtccctgtttgcagatgacatgattgtatatttagaaaaccccatcgtctcagcccaaaatgtccttaagctgataagcaacttcagcaaagtctcaggatacaaaatcaatgtgcaaaaatcacaagcattcttatacaccaatatcagacaaacagagagccaaatcatgagtgaactcccattcacaattgcttcaaagagaataaaatacctaggaatccaatttacaagggatgtgaaggacctcttcaaggagaactacaaaccactgctcaacgaaataaaaaaggacacaaacaaatggaagaacattctaccctcatggataggaagaatcaatattgtgaaaatggccacactgcccaaggtaatttatagattcaatgccatcccccccatcaagctaccaatgactttcttcacagaattggaaaaaactactttaaagttcatatggaaccaaaaaagagcccgcattgccaagacaatcctaagccaaaagaacaaagctggaggcatcatgctacctgacttcaaactataccacaaggctacagtaaccaaaacagcatggtactggtaccaaaacagagatatagaccaatggaacagaacagagccctcagaaataataccacacatctacaaccatctgatctttgacaaacctgacaaaaacaagacatggggaaaggattccctatttaataaatggtgctgggaaaactggctagacatatgttgaaagctgaaactggatcccttccttacaccttatacaaaaattaattcaagatggatcaaatacttaaacgttagacctaaaaccataaaaaccctagaagaaaacctaggcattaccattcaggacataggtatgggcaaggacttcatgtctaaaacaccaaaagcaatggcaacaaaagccagaattgacaaatgggatctaattcaactaaagagcttctgcacagcaaaagaaactaccgtcagagtgaacaggcaacctacaaaatgggagaaaatttttgcaacctgctcatctgacaaagggctaatatccagaatctacaatgaactcaaacaaatttacaagaaaaaaacaaacagccccatcaacaagtgggcaaaggatatgaacagacacttctcaaaagaagacatttatgcagccaaaagacacatgaaaaaatgcacaccatcactggccatcagagaaatgcaaatcaaaaccacaatgagataccatctcacaccagttagaataaaaatcattaaaaagtcaggaaagaacaggtgctggagaggatgtggagaaataggaacacttttacactgttggtgggactgtaaactagttcaaccattgtggaagaaagtgtggcaattcctcaaggatctagaactagaaataccatttgacccagccatcccattactgggtatatacccaaaggattataaatcatgctgctataaagacacatgcacacggatgtttattgtggcattattcacaatagcaaagactaggaaccaacccaaatgtccatcagtgatatactggattaagaaaatgtggcccatatacaccagggaatactatgcagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacttggacacaggaaggggaacatcacacaccagggcctgtcatggggtggggggagtggggagggatagcattaggagatatacctaatgtaaatgatgagttaatgggtgcagcacaccaacatggcatatgtatacatatgtgacaaacctgcttgttgtgcacatgtaccctagaacgtaaagtataataataataataaaaagaaaaacaaaaatcaaaacaaagaaataccctgagtttagaaatcatctctatatcttatctcttatttacctgccaccattccaccatcttctcttaaacctactctcatcagacattatctccttgaaccccaccatactccaccaaaacttttgtcaagtttagcaatgacctacaggtcctaactctaatggtcacttctcaattgtcaacctatgtaatctatcagcagtagctgacattgttcatcattccttcttcctgtaaatactttcttcactttgcttaccttctacctcactagtcacttgtaagtctcttttgctaattcctcctttttttcccctaatctcttaactttgggtgtacttcaaaactcagtccttggtccttgttgctatctaccttagtgtccatcctccagacttacagctttaagaccatccatgctgatgatccccaaattcaaatttccagtcctgtattacatctccagttggatgtctaaggggcttctcagtcataaacattttcacaactaagtccttgatattactcctccccccaaagaaaacaccattggctaggcacaatggctcatgcctataatcccaacactttgggaggctgaggtgggaggactgcttgagcccagaagtttgagaccagcttgggcaatatagtgagaccctgtctctagaaaaaaatttaaaatgaggtgagtctggcagtgtgtgcctgcagtcccagctacttgggaggctgagttgggaggatcatttgagcctgggaagcagaagttgcagtgagctgaccatgccactgcattccagtctgggcaacacagtgagagaccctgtcttgaaagaagaaaggaggaaagaagaaaggaaagagagaaagagagaaaaagaaagaaagaaagaaagaaagaaagaaagaaagaaagaaagaaagaaagaaagaaagaaagaaagaaagagggagggagggagggagggagggaaggaaggaaggaaggaaggaaggaaggaaggaaggaaggaaggaaagaaagaaagaaagaaagaaagaaagaaagaaagaaagaaagaaagaaggaaggaaagaaagagagagagagaaggaaggaaggggaagaagaagaaggaggaggagggaaggaaggaaggaaggaaggaaggaaagaaggaagaaaacatccctaagctgcgagttcttcccataatttttcccatcttagttaatgcaacattatcctcccagttgctcacgtcatccctaactcctctctttttctcacacccgtcatcaaatgccaacaaatgtaagggctcttccttcagaatattttcagaaggccaggcacggtggctcacacctgtaatcccagcactttgggaggccgaagcgggtggatcacctgaggtcagaagttcaagaccagcctggccaacacggtgaaaccccgtctctactaataatacaaaaattagccaggtgtggtggcatgcgcctgtaatccagctacttgggaggctgaggctggagaatcgcttgaacctgggaggcggaggttgcagtgagccgagacggcaccactgcactccagcctgagtgacaagggcgaaactttatctcaaaaaaaaaaaaatatatatatatatatacacacacacacatatatattttcagaatctgaccacttctcataacttctacggttaccaccctgcttcaagccattatcatctctcatttggactgctgggatagcctcctaactggactccttaacttccattcctgcccttcctcccacagtctattctcaacactgtgactcttttaataaacaagtcaggtcatgccattcttctgctcaaaactctctaatcattctccatttcattcagagttaaagccaaaatctatacaatggcttccaaagccttactcaacctgacctccttacatttatgacttcatcaatacctactctcagctttgctcactctgctccagctgctctaaccttctcgttattcctctaaacactgggcatgcttccacctccaaaaccctgcagaagtttttcctcttcttgaaatagtctcccccgaccatagatgtcttcatggctagctttctcacctttttcaagtcattgcttatatttaatactgtactccccgacctcttgcattcccaaacctcctcatcctgttctatcttttcaataagtcttgtcaccttctcttttgtttgggttgggttgagttttttttgtttgtttgttttttgttttttttttttttgagacggagtctcattctgtcgcccaggctggagtgcagtggcacgatcttagctcactgcaatctccgcctcccgggttcaagtgattcacccacctcagcctcctgagtagctgggactacaggcgtgtgccaccacgcctggctaatttttgtattttttagtagagacggggtttcaccatattggtcaggctggtctcgaactcctgacctcgtgatctgcctgcctcggcctcccaaagtgctgggattacaggcatgagccactgtgcctggcctaagtcttgtcaccttctaatcaatgatttctttatttaatattttcatctcgttattgtctgtttctcactgttggaatgtaagttcctctagagcaacaatttttcactgttttgttaactgatgaatccacccccaacttaaaacagtgtctggtatctggtaggtgttcaataaatacttgttcaataaatcagtaaatgaaggaatcagaaatggcctttaaaaataaacacatttaaaatgttcaaatatataaagaacaaaagggaaaccatgcaacaaataggacaatatgacaaaatagttttaaaagtagacgcctcattgggcagtaagagacatagatactgagatcagacagatctgggtttgaatcctggctctgacacttactgtgtgactttgggcaacttattcaatagcaagactctgagatttgccatctgtaaaactggaatgataatgcctcacaggtctgttgtgggacttaagcacccagtaaaatgcacaaataggaagctcttaatacagtttagttttcagtgttattattctttttcagggctgaccttctttgactactttttagaatcttaaataagtatctgttgaatgaataaatgactaaatgcctaccatagtaggtataaaatcagtgcaagatgctctcatgattattccctaaatcaggtttgtcctggactctcatttgcaagtaatcagctctagccgactgtttctgtgttgtctgcttctgtcctacctagctcttggttcatgctcaaagacagctgcttctgaagatcccaccccacctgccacctcctgacacaatggatttgggtgcaaaagcaatctgataatgcacaagctgcaattctgccaaacatgcctgtttagtgtaacatggctaaggagcaacctgtctctaggaatggatggcagaatgtgggtggctactaacataagtcacctacactcatcattaagagaagtatttgggacagagtcaattaaaaaggagatccaaaccatatcattagggttaatttttctccacacctgatgcaagacatttctatgtactctcacttaatgtcttgtgtgttatgaggatttccagtatggctggtaggaacaagaactgttactaaccctttgtgagtactagtattgttctctgtaatcctctggaatggttttcccctagccccacttcaagtagcttcctcaagtgaatatgccaatcaatatgctgctgaatactagagggggcccctcacagatctctggcattctttctccatgcagctctctcttctctaggactccgctagcaaacttagtctccctatactctcacctcaatctcaactcgggcagtccactgggctccatatgtgttctccctctctgcaatgtggcctagaaacttgctatgtagtaagctctggtaactgtgaagctcctctcattgatttccaattgctcaagaatccatggcctttgctgcctgctggccattatcatgaaaactgttgtgtcatatattttgtctgttttatttttgcccgtttcaggtaggcaagttaacctggccccctcactccatcttggctggaagcaggtctcacaatttcatggaatattatacagttttaaaaaatgatcaatgtgactgttgaaaaaaatggaacttagtgataagtggaagccaagggtatgcagtagaatgtaagctatatttttcattgtaactacatgaaaaatatatacgttggtggactaagactgaatgggaataagcaaaattaaatagcagctgtgccacagcagtgggattatgtgtttctttttttttttaaacagcccacttttctctaaatattataattacttaggcattatatattttataaaatgagaatattttaatccagctttcttcaacatatactaagtttagggactctggattcttcacacacagtacagtataaaccctgggtaaatatttatttactgacgggctgatgaagcaagcctgacaactgtgtagatgttacactgatggctagagctatatggttggcttggccccttttcccagcatacctgtaattagtttgtgtgtaaacagaacactgctctgtctaaattagcattcttctaccttatttcctctttgtttcatacttctttgagcagaatattaggttaagcagaggtacttattcggaatggagaaagttttattcacatagacatactttgttaaatgagcaatacttggacaattcaatacaaaatcagcacttcatgtttaaaatatgtgctcatggcatctccatattacagaagaacttaaatactgaaaagacctgctgtctgcactgatcccagtacaaattcattcaggcaaaacacatggaggcctgaaaaccaaagttagagtctatgcatgcagcctgtctatactgctcttgaaatccctttaccaaatatttgaagagttctataaaaataacagagtgctttaacatagagtactcatttgtgcatctaatatttatgactgcctactgtgtgtaacaagccttgttcaaaatactggggatatgctgaccaacaagacagccaatgatctctcctctcacagaggtttcattctattataggagtaaaataaatatcccgataagattcctttgagcattattatatccccatgaggtagcctggcagagattattattactacttccattttacagatgaggaaactgaggctgtccaaggtaaaacaactttccccaggccatgtaactggtaagtggcagaatcaggaatcaaacccttgtcttctgatgtctcggtcatgttttctctctgtagcactgttaccactgtggtgatccagcctatcagctatggtacatatacccatagagtggcatgtaaggtgaggaaccaccctgtcactttttaacgtgggaaatgccttctgggatacctcttctgttcttctctacctctctccttgcagtttggttttatgtcccagtctagagtttcatcagatcactgagggtagacccaggtagatttctattaatgtatgtcccttaaggattctttctagtcatatctggttaatgaataaattgatgatacattcgttgtcttagagaacggatgcagacaacctaggctaattaggcactaggttctagccttcatggctttctacaccaggcaggtcagtaagtaaacttccattatgaaatgtactcacaaggcaaaaagaccctgaacaacatctgggatacagcttagcttaattctttttcaagcactacagggaccattcgaagtctggcagttactggctcctaataagaaatgtctacaagatggcaactgtggaacactgctcatgtgtcacatccatatgacatacttcttggtaacacacattaactaaataatcaacatcacacggataagggtctaagattgtagtctatggtcctcaatgtacatacgtctgagatagcagcagcagcagcagcagcagcgggttcaacgtacacggctttcatgctagtgtgtcctctttgaccttgagagctactataaataggaaaaaagagagatggtaagcatatctcactcgccatttaaatcaaaattttctatcatacaataaaaaggttcaaataaaaactatttgttttattttccctactacagaacatcattaatctttgaggtatcatttttcccacagagttgttctacacatctacaaaaaaaaaaatcatctggaccctcattagaatgaagtttgctgcaggtctcaatgcctttttaacagtggggagcaaaccaatatttttaaagccaaggtgtttgagtgaatattctttttcaatttttaaaccaactgcaattacaaaaaaaaaaatgcctttaggcccaatttaattttgtttcctgtaattagagaaactctccattctcggggctcattaacaattcatttctatcaaaattagatagaaatttgcccagggtgagatgcagcttcatggcacactagagtcgaaatactagcttacttttcaccaattaagtatgggtgagaaaatatgaatgaatgagaatcttatttctaatattgataatagtgtttcaagccttaaaaatttcataactgagattctgttattgaaatgtattttgttttcacgagtttttctttagaaaagcccctattactccacaaaatgagaaattaaagtctgataataaatattataaaaaacaagacctcagagcagcaagacagtggcaaaatgatatatataaaactttccaagcatattcagaagacacataattaagagaaaacctgggttatgccacatgatttcaaaaagtgaattctgatccaatggagataaattttccattatgtatttcagaggaccctgacaaaaatccattttatttatatcatttatttctaacactaaaaaattaagagcttgaaaaatgtatttcggatatccaaaatacgtaatatttaggaagtactgatttgcacagcataaaacaactagttaatgagttaagtcattcatttgcatgtataactggactatatcgaatacagaatgtttaaaatatataaaaagtatatatttaattaaatatatttattaatattttatgttgttaatattaatttaattaaaatataaaatatgtaaaatataaaatatttcttactggtttgattttcagtgtcatgaaacaaacataaatggagtcacttgtaaatctgcccacatattatttaaaaacaaaattcctatattattacatatttttaaaataatttttcaacctccgactaaatttataagctatgttagtctaacagaatgttttctcacatcataaatgctggtacctcttcagggctgctcttggagttctgttatttctttatattatctgccttgcagaccatgtcgtatcccttggcttcaactatgcgtgactcccacagctctacctcaagacctcttcccaagctgtagacccacatatccaactgccttcagcacatgcatgtgggcatctaacctcaattcaacatggtatagactcctgttccccactccagtgtctcctacttggtgaacagtgccaccttccacccagtcactcaagactgaaatctccaagtcatcctagactcttccctctttctcaactctcttctgccttatatgaatgtttcttattactttctatctactttttctacctggttaatttcttcaaggcaatgaacatgctttaaacttcttgtatcccaggcacttcacacaatggagagcaattactatgtgcttaatggatatttgctaagtaaataaaggaataaacagataaaacttagtagtcaattcaatcaaaatgttttcacatccttcatcccaagtctgcctggattgacaaaattattttaatgaacaagctggagcttctatttgttgcttaaaagcaatctaatacctttatattggcttctaaatagtgcataactttatatctgagataaacaacataggaatatattgcttgctgcattgtccaatatggcagtcactagacacatgtggctaaatcaaaatttaagttaatttaaattaaatacaatttaaaatttagtcttcagtcacagtagccacatttcaagtgctccgtagctagtggctgccgtcttggatgaagcagattataggccactgcaatcatcacagaaagttctactggacagtgctgtattaaaggatgcagtaagttttactggacaaaactctttgacagcaatatgttgtgaagcaagtatgttttgtttcaaatccaccgacttaaatatcaagaatataaatacaagtaaatattttccaaattattcagtgaatttacattttgtgcctctccataagccagtataaatggcaaatatttgatgtagaacataaaagtcacaggcactctgggaggccaaggtgggaggatcacttgaacccaggagtttgagaccagccaggacaacacagtgagatcccatctctagaaaaaataaaaaatgagtcagatgtggcggtgcacaccagtggtcacagctattcaggaggctgaagtgggaagatcacttgagccggggaggtcaaggctgcagtgagctgtgatcacgccaatgcactccagcctagatgacagagcgagacccgaaaacaaaacaaaacaaaacaaaacaaaaaacacctcacaattaaaagtcacagagaagcacttacaattttaaataaaaacattagggaatatttaatacctaactagtttgtgcatgtaaataatgagtttgggctcaggatatgggatataacatgtaacagagggtttgcagccatatccactgctggcctttggttaggaacagatacaagcacaactttctttgtccaaattgtatcacttaatttttaaaaataaggagaaagatcaaagaacactttgccagttgtagttacgtaaaaataacacctaattctacaaagaaaagtacctctgtctcattatgtaaaatctcaaaatattactcttaaatcgagcccttcatgtttcttctctctcttcattttaaatattttaccgaggtttgatatccattggtaaagtgctcaacactgctgaattactttaatgcaaggttgttcttggcttaaaatatcatctacttctacttgctgtataaatgaaactgtaaatatgaaaaagatgtcaaatgaatactgtcctttcatacgtcaatggagtacaaactaaggtgtgttttgaacagttgtggcagagagtcaggaaactgatgacagtaaaaatataatcctaaatgtctctccctacttaatttacagctgagatgatataatctgaagtgatggagggaaagaaaaccagatttcccttcttggttgcaggttatgaacaaagtttatggagctaatttttaaggttactctaaccaaggcttgtctacaggctctcagaggaagcccactaccatgccctgtctgaaatgtaaaatcttgagtcaaggatcaggtatcatcttttccttcaaatccaactgcatctcagccatccttgataactagatactagcagctccaaagcccacctctcctgaagagtcattatgttcttagaagaggattcctgttaagtggctccctgggaattaagcctgaaacagcctctctttgccccagcctcccactattttattcagtattctaggcaagccatggaaggtgaacagaagctggggtcacataccctcaacattggtcaattatacctaaataaagctggaaaaatatttttctcaactccacatgcaaaaagtgaaaacaaaattctgaaaaattaaaaaaaaaaaagaaaaattacgttgtaatctgtacagtccccataagtgtggtcagttcaaatgccctcattagccattctttcattgaccaccctatgtctctaagtttctattccacttaactatatgatttgagaggcataatactgtaatttgctttacaattgttcttttgtaattttaattctctctcctagaaaacgtcttcctgcaagatgagttctgcatgcactatcatttctctattcctttggagccaagaagcaggtgctctagtgttaagatgagcagactagggatcaagagcctgggttttgtgacttgaaactgcactgagagagttgggaatgttgctattgctgtagatcacctagaccaataccctcctttgagggggagaagagaagcgtgttctgtggctacagggctctgcatacaatgtacacttgtaaatatcttctgaatcaatgtacaaatcctgatccttccgaatacaaaataactacactgccttctaaatatttgataggtccttctctttcaatatagccaccttttattaaataaataattggagatagtcgtcttaatagatttacattatttgaagatgaatttagttcattttaggaaccttggctaaaggcagatagtcaatggatgtaatttggatcggttcagaatatcagtaacttgaagtgaatgcttcatcatcaccctcaataatcttaaggtaaatgctaactaaccatactccctacccacgaccaatctcatctctgactgacagaaaagacactatcatttaccaagttcctacccaggggtctgtatcttacacatattacctttctgaatcctacaataactcaatgacatatgctctgttatcatctctgctttatagatgaggaaaataaagctttataacatgaataacatataagttcacaaccagtaagtgacaaagccagaatatgaacccagtctgctaactccttataccagtaagggcaatagttgtgtcaccactagggagtagtaaaataatctctagttttgtttaatcccagccagaaatgccttgattttgtcatgtcacacgtccaatatgccctaatttgtttatttttacttttattttttatttttatttttgtgtgtacatagtaggtgtatatatttatggggtacatgaaatgttttgatagaggcatgtgatgcctccatttgtctctattaccaaaatgtgtatgtctttgaaatcgataggctcatatgttaagatccattccatcactgtatattcacaccgcagcttaacccactaacatcccccacagaatgaactgcagatacctatgagctattaccaactttgccaggtagtttgtgcacactattgtttccaggaaggatgcaatcttgaccaactcctggctccttcttagttttgcttctggaaagccactgcttttcagtatggaagcataccaacttcccaagtcaatctgctaataggaaattttccaaaagccaacttgccaggagacaaatggactgaatgaacatgaatcaaagtaacaatctgtcaaattatccaaatatactgatttaccaaaaacctgtttttttaagctattcataaaatttgcagtatgctgagttggcagagtttaagactatcgttggaaggaaggatttcagagtcctgagggcttcagacacctgcttagctcctcatttccttctctcatggactccagtttcctcccaacccaacttcaggggttggaagcccaagctgtgctggatgctggctctcctttgtttcttttccccattgcaagttcccctctcttgtcccctgctcaattcagctgcagcagtaagggacctggggtacagacaaatggaacctttcctaaaatgttaatagaaaaattggccaagcacaatatatcctaagtatcttcaaaaactgttaaaatatttcaatccactctaagtcattaagttttatcagagttcaaagatataagtttggggaaaatggtaaatttggcaaataagtcatttgatgatattggtgataaaatctgaaaacatgctaaatcattgaaaaattagaaaatgcattctttaaaagtgtattattaaattagcatgaactagaaacattcatatgaaatcctgaaattctgtttttattcataagaatggtaaaccattctgtgacttttaactttttacaaattaaacattccttaaaatgttgaaaataagaatatatccattgactataatcaagaatgtagtcattgcatataatcaagaataatatattgatatgaacagatacttagtatactgaatagataagggatccaaactatggcctgtgagccaaaatcagcagcagcctgtttttttacaatgtaagaatggattttgtaatttgaaaaaacacgagcaggtgattggtttctttctctccaatgacagcagaggcaatggacaacttacagccagaaaagcccattgcgttctcacttgggaaagatcttgatggacctgaagctgctcaagatcatgccttcctgctaacaaagggacaacaaatcccatcgtttaccatcttagcatataaatgttttaggaaacttcctgagtgactgcttccagaaattttcttttggcttaagaaattaacttttagtcacaaaaagttctgtcttttttgatgtgaggggaaaagtatgatatttcattaagatattctgaatggaaggagtgtgctatttgaatttacccgtcctctccagcagagtaatttattacttcagggcctaaaaggatggggaaggaaaatgtctggtatacgcgcgcgcgcgtgtgtgtgtgtgtgtgtgtgtgtgtaagtacgcgtgtgcacacgtctatggtgtgtgttgggattgagagataggcagaaagtgaaacaagatgactcaggaaataatgtacccttctcctctccaattccctatcctgagcaccacaaccctcactgctccctggccatagcatgaagaggactgactttcatgagacaatgagttagggtctataagcatctttccatttcagccttcctgttttcctgtacgagacacagatatggattcttatggctttcaaaatcatattctttttgtgggttaacatatatataactgatatatctgaagctgatacataactgaacctacaccatatagattagttcagataatttcacgtattagaaaatgaagatttaaaacaaaatgttgagtttctactatttataacatgaggtcccttttatctggcaggtaattacttttatggcatagctaagaaaattcaattcttcttttagctgtatggtaaagacttgcttcaaatcactgctaatatacaactaaaaatctatccatttcatagaaatcagcactctctaaagggccattttgaactcctctaatgtgctttttttttggttacaccagttttccacaaacacatcaaaagaggaaaaacaccgaacagcacttggtggtatttcctcaccagaattaaaaaaaaacaagtaatacacaatattcatcacacttaaaaagtaaacacaaatcatcaacatggtagaaatcttagtctgatgtaccccgaagagcaattaatctgtggtaagagttgccctaatgtcaaataataaagagaaaacagaaaaatgaatactaagtcaacaaaaactctattgctataaaaataaccaaaaaagtttcaaggttttgtcatctcaaaaagaatattgctgatattggcttcctctgagcagtgtagaaatattaagtaaacatgaaggcaactttagaatctgattagtgttctgtggtccgccccctgccccttttcaaacgtagagaaggcaacatatagctttggttggtgagtcactggaatatgcctggatgccagctgctaacactaaagacattcatgggcagaatgaatgtcaaggctacacagttccccatcatatatttgtggaaaattcattccaggagaaattcataaatcagacacaagactatactaagaccagcactgtgtggtaagatataaagaaagtttgctctgttcccactaactaataagcccttaaggccaagccttccaactgaggacaggatgttctatagggatgcatctctcactcaaagaggacagggtttttgaaggactagaactgacagctcagatataatttctacagtttgtaaggtactatattgacttttatatttcattattttcatatttggatccattatcaaatatttttccagtctaaaaactattttatgaattaatatttgtcactattcagtcaaaatgatttgctttcacttcaatgaaacaagacacacacaaacacacacacacttttacatcataaaacagggcaggaccaacttctttttaatacatccagtaacttcagagcgcctggactaggtacatatgttcatgctaaggttttgccaaacatcccatgttttatttggcatctgagtcttcctatttttgtaactgtctcagtcatccctctaaggtaacatggtatatggtttttctgtcacttttataggactattattgagccaggcggggaaataaagcaacaagagaccagtcgagtcccagcatatgttaaaagaaaacgttttatgtctttgctatttattaaaactctaatggcctgtgttggctgtgcaaatatgagatatgatttgaagtttggccttgttttctctttttgttctgaaaatcagctctgttagtttccaatggcaagatggacccatagctaaacacatgactgtattctagaaatcagaaaatgaattaattgaataaaatgagctagtctgtgtactgagggagacacaagctgaatgcaatcccactctcagcaagcttttgattttctaggagaagagctaagtcagtctctgtgatctcaaggcaaagtggagagtgtcagtacgagagtagaaagcagggaggaagagctcttccgaactgggcaccaggaggaacttctcagagagggaagatggaactgtttcttgaggggtgagaaggattcaggtatacaaaatatagtggggaaaaacattttagtccatgtagaaatagtgaatgaacttaaatggcatgtatgcagaatggtgtagtttcttgtagtattgtagtttctcgtttcgttgtacatctcagcactagacagcaagttttatgaggataggcacagtactgggcactgcaaacacagtctcatggatcttacagtttcatgggaaatccagacaatgagtgattagtttagagataactataaagttaaaaattgtaataagtatgattaaggaaaagggcagaatgccaggggagagaataaaaaataaacttaggggaaccaatataaggcaactattgaacaacataatggaaaaatatttcaggttgaggacacaaacttgtgcaaaggctctacgctggaaaagagtgttgagaattcacagaaaagagaagccagggaggctgaagtctgacagacaaaagggaatacaacacaaaatgaggtttcagaaataagtaggcatgaaagcagtatgctttacagaccatacaaaaggagtctggattttattccaagtgcaatggagaaagcaccgaaagtttttgagcaggacggtaacaacatcatatttcaacaaatgatactggaacaactggacatccatataccaaaaacaatgaactttgacctaaatctcacaccttataaaaatagtaactcaaagtagatcgtagatacaaacttaaaatccagaatgataaaacttttgggaaaaaaaaagtttatgtggtcttggttcggtaatgaattcttaagacatgtcaccaaaagcaatctatcagagaaaaaaaatgacaaaatattcctttcttaaaataaaaaccctttgttctgcaaaatacactgttgagaatgaaaatagaagccccagacttgagaaagtacttgcacatcaaatattgaacaaataacttgtatccagaatgcataaagaattctcaaaactcatagactgtggtgaggacgaaatgagttaagatgtgtttaaaatactctgaaccatgcctgatacacagtaagcactcagtaagtgttgttattgttttcttttcttttttttttttttactttaagttctagggtacacgagcacaatgtgcaggtttgttacatatgtatacgtgtgccatgttggtttgctgcatccatcaactcgtcatttacattaggtatttctcctaatgctatctctcccccagccccccactccccaaaaggccccagtgtgtgatgttccctgccttgtgttcaagtgttctcatttctcaattccacctatgagtgagaacatgcggtgtttggttttctgtccttgtgataatttgctgagaatgatcgttttgtatgagtatgatttcatagttgaggatatcaaggttcaaggaagtcaagctgctaaagttaatacagcaataagtgacaaacccagaatttgaacccagactgttagctttggagactacatttttaatttttactgctctgactttgcaaaattaatattagaacaatgtttgcaggatgttgcaaagattaaaggcaatgaatatgagaaaatattttgtgaataaaaaatgaaactgaaaaaagaattctcaaaattcagtaagaaaacaaacaacaaaattttaaaattaggcaaaagattcaaacatacactttgtcaaagatgtaatgatggaaagtgatgaaaagatattcaatattattagtccttagggggaatgcaaattaaaaccataattcaataccactgtgtgcctattagtggctaaaattttgaaaaatgacaacacctagcactcaggaggaagtgaagcaataataactcccatacaagctgggtgtggtggctcacacctgtaatctcagtattttgggaggccgaggcgggcagatcacctgaggtaaggaggttgagaccaacatggtgaaacctcccctctaccaaaaatacaaaaattagccaggcgtagtggtgagcacctgtaattccggctaccaggaggctgaggcaggagaatcacttgagcccaggaggcacaggttgcagtgagccgagatcaggccattgcattccagcctggacaagagcgagactctgtctccagaaaacaaacaaacaaacaaaaaacaaacaaaaactcccatacattgccagtaggaatgcaaaatggcacaaccaccctggaaaaggatttggtagtttcttataaagttgaacatacaattactgtatgtactaacaattctattcctatctaccctagagaaatgaaaacacgtttaccaaaatcttgtacacgtttatcacggtactattcataaccgccagaaaactggcaataacacagaagtccttcagcaggtgaaataataaactgtggtacatacctacaatgaaatgcaactcatcagtaaaaagtttttgatgcatgcaaccactcggatgaatcttaaaggaattgtgttgagagaaagaagccagtctctaaagattacatactgtatgactccatttatatgacattctcaaaaacacaaaactataaggatgaagtatagatcagtggttgaaatgggttaggggtgaggtggggtagggctgacaataaataggcaggacaaggaagttttttgagggatgatggaactgttctgtattctgattatggtggtggttgaatgaatctatagctttcttaaaatccacagaactgtataccaagaggaaaaaaaaaatttactgcacaatttaacagatagattgtttaagaaataattttaaaaatgaaaatacaggctgggcacggtggctcatgcctgtaatcctagcactttgggaggccaaggcaggtggatcacctgaggtaaggagttcaagaccagtctggccaacatggtgaaaccccatccctactaaaaatacaaaatttagccaggcctggtggcaggcacctgtaatcccagctactcaggaggctgaggcaggagaatcatttgaacctgggaggtggaagttccagtgagctgagatcacgccactgcacttcagcctgggcgacagagcgagaaatttctcaacaaattaaaaaaaagaaagaaagaaaaagaaaatacatatccacagaaagactttttttaaagaacgttcattgcagctttatttgtaataatccaaaactagaaaaaaatgtccatcaaaaggaaaatacgtaacaaattgtggtatagtcatacaatagaatactcctcagcaacaaaaagaatgaactactgatacgtacaacttatgctgggttagaaggcagaatcaacagagtatatactgtatggttctatttttatgaagttctagtaaaggcaaaattaatctagagtgaaaaaattcaaaatagcagttgcctctaggtgggaggatgacagagaaggggcacaaagaaggcttctagtgtgctgaaaacattgtatatctttaaaaatttttaattaagaagtaaaaattatatatgtatttctggtgtacaatataatgttttgacatatgtatacactgcgggatggctaaatcaagctatttaaaatatgcaagcattacctcacatacttatcatttttgtagtgaaaacacttaaaatctactctcttaacaattttcaaacataaaatacattgttattaaccatagccaccatgatgtacactgtaccatcttgacaggaatgaggtttacacgggcttctccattcaaagctcatggaatgatagacttaagataggtgtattttactacatgtaaattttactttacaaatgtaaatactattaaactcaatttagaaggttttctttttgcaatgacataagttggcaaccctgaaactactttctgtgcatttgatatttgagcaagtaagtaactatattgaggacagtggggccaggcctttgtgactattggaaaagagtgttgcaaatacagaaatgagaagactagaatgaaccctatggtgttggcttagaatctgaagcatcactatgaactcatgatttgtattattttatatacactcatacacaaaggtacacatacatatagatatgtatctttatatgtaggtacatgtgtatttgtttcctagttctgaaagcacttaaaagcagtggcacacaagtaatgatgaccagaactaatgcctagatcttggtttctaaatacttctgattaaagaagctggagttgctcagactaagacttagagaactggctgatttctctgaggcagagaaaatacaaaatgaacctgaaaagtcttgtgccaggtagtaagggtgatgctcaaagaatgacagggcacattaaaaagagatgagtcagctggaagaggctcccactggccaattctgagacaatgtgagcattaaaataagtaataatagtagtatattataagccagtgaataaataaataacgattcaattaatgaggcagaggggaaacttcctaaccaaaatgccaaccaataaatgtagaaggtatgatgctgttagaaaattatcaacaggtactaagactagtgggtaaaaatttcttgaggaacagaatatttacatgtcttcaagtactttcccataagttacttaaaatttacaaagggaaattttactttacaggtgagaaacttggtggacatctctttaaccatgtgatcaaagttcacatcagcttatgagaaatatcaacaccatctatcttttgatatgtcgtactgagaatacaacattgcttctgtggtattcctgataaaaatgcgtaacttgactctagttaagaagacacatcagacaaacccaaatggagggacattccataaaatatttagtctgcactcatcacaaatttcaaagttaagaatatcaaaggaagtctgggaaactattccagtttaaagacatatgacaactaaatgtaatcgtgatcctaaattggatcctataccaaaaaaaaagctacaaaagataactgacaaaatttgaatatggactgtggaatagatgataataatattccacagataccaaaattcctgatattataaccatactaaggttatgtattataataaacttgaacataggaaatacatagaagtatttgagaaatagaggtgtatctccacagtttataataaattacacacacacaaaatatctatctatatgaagagagagagaagagagagggaagaaaagatggggagaagttgagagaaggagagaagaggagagaatgataataaagcaaatggggcaagctgtaaaaagttgtgagtataggtaaaagaggacacatatagttcctgccaatattcaaataaaaagttaaaaaataaaaagaaattttaaaaatggcaatggagctaaagcaaaagaatgtctcaagataagaaagaggtaaagccaaaatcattaagtgaaaagagagctggatgaatcccattccacatcttcagatgaccaacacacaagctgggcaactatattgtggaatggcaaatgaatactgtgagaaaaaaataacattattacttgagaagaatatgcagctgtgagaatatttatttaaaattgcttttcataaaataggcaaatatatcagataatttgtcccagtttttttaaacttttatatttattagacttttttcattagtgtctaaacctcagtaatttcagtgctgcttcaataagtctttagtacaaacccttacacagagcttttcaaaaaatattaacaacaaaactgctcttatcaattgcaaatctaatagtttaatgattttatgcatttagatgatcaaaataatttgtcatgtagctgaagatggagtatgggttggctagagatcacatcataaagaaaatgatatataaaacccaggatcctgagactgctatcccttctacctgtgtcttttgatgtctgtccttttcaaggaccagaccctgtacatgctactaatatgattagttaaatgtacaccaaggggctggcttcaaatctaacaaatacagctgcgtggaaatgggctcaagggttctttccctggatgtaagcctgaaaagccccaactcctttccttatctgctaacaccaggtgtcagcatgtgagtatctgtctggtgggtgtcggagcacagagtcatctggctgtatgtggcctccaagctggaagtttcatcatattcaaagttgggccgcacccacttcaccctgcaaggagacatggatgctcttcatggaatgactcggttgttcatggagagagtaccatctcagtatggaggtttcaaatgtactggctttaagcagaaaaaaaaagaactaccttaaatttatagaaaaataaaaagaatattgaagaaatcaccagacacaaacttcagatcatgactgtctgctatgttcacaggtagccctttgtagttaatggtgtctgcatagattagtaaggactatagtgttaaattataattactccatatttggaaggactttctaatccataataatttgactttgcatagtattttacaaaacatatagatcttatttctttttttttttatttgagcctcacacccattctgcagtaattatcttcatcatttatagataaagaacataagacttaacaggcttctccaagatcacacaaactgtaaatggcaaaactgagaaataaaacctgagcattatagtttttaaaaatcctaattttatgttgttttaaaactatattacaagacctccacagtatttgccaaaggtgataggtagaattagtagagtagaattagtagaaatagccaagtaacgtgcaaagggagagcaggtagtgttgactgagtctccacacggcattgaaaaacaagagaaataatggtgaatgactctagcaggagctattccacaaggcagggtcgagctgacacgatcctgggtccttccctcacagttgctcacaggccctgcatgctctgaatgttcctctctggtgactctgctccagctatgctggctcctttgctgtttctcaaacatatgcttctgccatgtacttctgcctcaaggaccttgcatctgctcttccttctgtctggaatatctcctccaaaatccacaaggcttgctcctccactcctttcagatgttaactcaagtcacctgcttgttgaggccctttctggccacaaaggaaccacagggaattgccaatattactccatttttaacctataaaatgccatttcaaaatctagtagtatttaacttccccccaataacattccctatacccctttcactgctcaattttttttcccttggccctcatcatctcacctgctctatagtctattgacttgtttattatctttctcctccaccagaatgtaatgaccacgaagataaggacttttgctcactaccatatccttaaatcttggaacagaaacttccacatagcagatgctaactattttctgtatgaataaataagtttcactgggactaaagtgataagactaggcatgctagccacatttacaatgatgtgcaaggcccctcctctgctcaagatgggacagacataaggaatggagtcaatacggtatagtatagtatggtaaaaagactcggtacaacaaaacctcactaactaggaccattgtacatctttgcaaaattttccccacacctttgtacaaggtgtctcttcactgaaagaggaattaggcaggaacattctttctggtggagttgctgacagatggagtctccccagggaccaattccagtcctatagcagagtttctgaggactttgcaagcacaggtaacagctactagaacctgggaaatactcatcatttgattttccagtgttttctactttacttttgggtgaaaatgtgccatctttgtaaaaagtattagggctaactaatcggtatattctcctccctctaagtttaaggtgaaattaaaaagaaaaatgttttctcttagtaacatccctggtcacatactttccaaagactccttgagttttctcccttgaatcacataccggccacagctcctgaaactggtgtcctcgtggaatgcagcccaggataacttaggtcccaaatacagctatactgcctaaccagctgtgtgagtttgggtgaatcatacatcctctgtgagtgcactttctcacctgtacaatgagtctaaaatctaccttatagatatgtagaaaataactgagttaataaacataaaataacatgatgaagtataaagaacaaattgcactgtgttaaaagatgatgctatgataggaatttgggccttaccaatacatgcaactgggcaaatccaaagagtaccttagttgcttacttctgactcttagcagtagcaagacagcagagggctactcagtattcacttttttgcctgcccctcactgactcacaaatcccttacttctttctaccttcaatagtccaagaaagcaagactttccactccggtacacctgtagcctcaatgaaaaataccccagctgttcaggccctctcctgaaatgaaagatttttaagcctcaaatcttaaacctgcacaaacaggacattctatgtggaaatacaccctttcttctaaatacttcaaattcccacctttgtgtttccttcataagcatagagaaaacttagcaggatgcttcttaatcttaaaaaatggaattaccaagataagggaaacattttgggagctgtgggtccctacgacctttgtgaacaattgcttttctaactatcccccagagggtaaaatggaagccagactattaataactaaaaattacaaccctgatatgatgcaatctcttctcctttttaattgaaaatatcatggggacaagggacaagtctatgaaaaaatcaagcaatagggtactggtttgcactttttttctaacaatactgcataatgtttgagagatctcatggcccggaatgtattaccattttgataagatcaagtaaccaatcagttaatgagcagatgtcacttctgcctactcattgtcaggttctgtgctcagacaagggtgagggtgacaggtcctgccttacagagttcaggttagtgggccagccaggtccaccaacaatccatcacatgagagctgaagagactggggccaaagtagtggccatggagttggaggagggagggatatgagagggacaagcagtctggaattaatcagacttttcttcattaaatgcatccgctttttccctaagtgtcattttctatcttacttcctacatgataaacaatccattgtctagttttgaactttaggggaaagagtgtgcgttcacccacatttgagtcataatttcttacaaaattagaaatgatataattttaagccttcagaaaacacttttattatgtatcttatgaagattacggcatagatgtggtagctggctccttgctgcatcagaatatttttcatccaattaaactctacctttaaataaaatatgagtatctttgttctctaaactctcactatctgaatatttgctacactgatatgctagtttttaaacaaaattcattacccaaacctgctaaataaatctgttttagggtgcatgcaagaatatgtttaagtcatgcatgcctagacaagagcatgtcagtgtgctgctattgtgtctcagtcattctccttatagcaaaacttgagttcatgttgtttaaacatgttgtcttgtaggtatcttacgttccacattattcagtaaaaggtcatctaagaaactagagaaactaatgaaggaagtgggcaagactaacaggcctattgaagtccatgtactacaagaaaagctgggagcaataaagcacattcagagactggctagaagtcttaagcttggtcgtgcacgtgctccccactcctaggagccaaacataaaacactgaagattcacgtaaaatttagattctggctggtcgcagtggatcacacctttaatcccagcactttgggaggccgaggcgggcggatcatgaggtcaggagttcgagaccagcctgaccaacatggtgaaaccccgtccctactaaaaatataaaaagtagccaggcgtggtggtacgtgcctgtaatcccagctactcaggaggctgaggcaggagaatcgcttgaacccggcaggtggaggttgcagcgagccgagattgcaccactgcattccagcctgggcgacagagtgagactccatctcaaaaaataaaaaataaaaatatcctgagactttgctgaagtctcagcccaaaatctccttaagctgataggcaacttcagcaaagtctcaggataaaaaatcaatatgcaaaaatcacaagcattcttatacaccaataacagacaaacagagagccaaatcatgagttaactctcattcacaattgcttcaaagagaataaaatacctaggaatccaacttacaagggatgtgaaggacctcttcaaggagaactacaaaccactgctcaatgaaataaaagaggatacaaacaaacagaagaacattccatgctcatgggtaggaataatcaatattgtgaaaatggccatactgcccaaggtaatttatggattcaatgccatccccatcaagctaccaatgactttcttcacagaattggaaaaaactactttaaagttcatatgggaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagaccaatggaacagaataatgccgcatatctacaactatctgatctttgacaaacctgacaaaaacaagaaatggggaaaggattccctatttaacaaatggtgctgggaaaactggctagacatatgtataaagctgaaactggatcgcttccttacaccttatacaaaaattaattccagatggattaaagacttaaatgttagacctaaaaccataaaaactctagaagaaaacctagacaataccattcaggacataggcatgggctaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacagccccatcaacaagtgggcgaaggatatgaacagacacttctcaaaagaagacatttatgcagccaaaagacacatgaaaaaatgctcagcatcactggccatcagagaaatgcaaatcaaaaccacaacgagataccatctcacaccagttagaatggcgatcattaaaaagtcaggaaagaacaggtgctggagaggatgtggagaaataggaacacttttacactgtcggtgggactgtgaactagttcaaccattgtggaagacagtgtggcaattcctcaaggatctagaactagaaataccatttgacccagccatcccattactgggtatatacccaaaggattataaatcatgctgctataaagacacgtgcacacatatgtttactgcggcactattcacaatagcaaagacttggaaccagcccaaatgtccatcaatgatagactggattaagaaaatgtggcacatacacaccatggaataccatgcagccataaaaaagatgtgttcatgtcctttgtagggacatggatgaagctggaaaccatcattctcagcaaactatggcaaggacaaaaaaccaaacactgcatgtcctcactcacaggtgggaaccgaacaataagaacacatggacacaagaaggggaacatcacacactggggcctgttgtggggtggggggagtggggagggatagcattaggagatatacctaatgttaaatgaagagttaatgggtgcagcacaccaacatgccacatgtatacatatgtaactaacctgcacgttgtgcacatgtaccctaaaacttaaagtataataaataaataaataataaataaaaatttaaaaataaataaataaaaataaaaattagattccataaaaacagcatgctggtacaaataaatgtgatcatggcatgagcagacatgtcacattgtcacattcaacacacaattacacaattattaatacaaatgcagctttatgttagcaagaatttttaatcaagcaaaggggatgtaaatagctagccaccatgagttctgtttctcatcccactgctctgtgtgtagcatcagctaaaggttgacaaccaatcacctctgtactcttctgatgggaatggaagattctccctgccttctcttaaatccagatgagcctcaaatatttcctgtttaactcattccttcaccagctctggcttccttacctcctcctgcccccgaatagtaaccgtgaccacagcttccagctcactcttctcaccatcagacctcatgcaagcatgcctttgatcccaagaaatctcttgcaaagttctcttgtttgcttattttattttgctaaatattactggcatacagtgcacatctttaatatatttaatatattacttcattatttatttaccagtacatgtacactgcaacgtagaaggaaaatgtaatcccctcccaatactagacactgtatagtgtatgctattgtggcttactacatacaaatgtgccaaacaatgagtttatcaaatgctgaataactatatagtattataaataatttatattttacagaaatcctttgtgggttgttaaataagtttataaaggggttttagtggtatctggcaaattaatcggcattttcctgggggttaggaatatatttttacttttctcacgtgaaatagtggaatatttgcttctattctctgaaaatgtgttagtaaacaaattttaaagaacacattagattcacaaaagaggaatgcctgtataattagcagttaccacaatgcatacttgctcttctaccatttaaaagtgtctaaacattacctttcttttcaagaaaaaaaagtaatgaagtagtatattaaaatgcattaccttaatttgaaagtcattacatgcctgggtcagttaagttttctctatttattgctttaatgctttttttaaaaaataaaaaataaaaagccaatcacctgtatttacattctgttggaaaaatgtgaattatatgagctgggaaaggaagttcagactagtagactgctattctggttttatttatttatttagagacagggtctcactctgttgcccaggctggagtgcagtggcatgatcactgctcactgcagacttgatatcccgggctcaactgatcctcccacatcagtatcccaaatagctaggactacaagcacatgccaccatgcttggctaattttttttgtattttttgtagaaataggatctcactatgttgctcaagctggtctcaaactcttgggctcaggggatcctcctgcctcagcctcccaaagttctgggactacaggcatgagccaccatccctggcccgtttgtttcttttttcattttcattttgatgggaaaaaaaatatctgtaggtgttatttctcttgttttagtttcgtttagtaaaattgaattctagatcttcattagctttatcaatactacctctcacctgagctctcccacaaaaggttcctcatctgaatcttgtgtaagtacagcttcatcactgactgcctttgaagtgtaaagttgctgcagaaaaattcaaatatttagacatttaatatgtatataaatagtaaaaatgcacagcatatattaattttggaggcatgctcatatccaatgttacaaataatctgcatatcaatgtgagaaatgcactggagttttacagatttgaaaactgaggattagagatataatgatttgacccaagaaatagagctagtagatccaggagcagaatttcaaagtttgaactgtgagttcatccctcttcccactgtactacacagtcacgctgtgaaaaaaatcttcctccaaaagcccgcctgtttgcacaagatttttttctccaaaatgtccactaatatggaacaaacatcctataaacccagagagaaactggactagaacacaaatagagttccttgtgctgtaagggctaccaaggtattgggccaaatcagatgtttttctgtttctcagaaaaggaagtagttactggggttgacttccaaaatgggatgtctgtattctcatggcagatgtgacagttcaaatcccagagggctacaaagacggaataatgaatggggcaactgaattaggcaacttccttaaactgcctttcttctatactacttttcttaccatctttaatttgaagaaatgatgacatatattacttgttctaaaattgaatgtaaaggccccctccacagtttctaaaatgtggtctgaaaagcccacgttttaaaccagagatgaaaagtaaagcaagcatgttgccctctctggatcactggcagtaataatgacagtaataacaatgatcacaacaactgtaatagctcacatttactgagtgcttaccatataggagaaactgtcttatttactccttacaaccctaatagaaggtactatgactgccatttatagaaaaagaaactgaggctaaaggatgtgacttggccaaggtcacagagctggtagggaaaggatctgaacacaggaaatctggatcagagccttcccttataaggtaatgagttggagatgttttatgttgtaacatcaacacaatattaacatggcccgaacagtgctcttgattctagcctcccacactgcctgatccacattgtcccagtcttgctaaaatcagttaatggcacctccatttgctgagttccacaagccaaaaagctaaaaatcctccacgagatgtttctctcccttctcctagacacttctaactcatcagcaagggcactacctccaaaatacatcccaagtcagaatacttgtatctccattactacaatcatagtccaagcccctatcatctttcacttaggtattcttgcttctgttcttgtttctctgtactccatttctcagccagtattcagcctgacctttaaaaaagaaaatcagatcatgtcaccttcctgctttccaatgcacttgaaataaaacccaaactgattaccatggatctcaaagttctacataatctgtcccctgcctatctattggatcttattttctgctgctccttccccctttcaccttattctggtcacataacttactttgttacttggaactctccaagctagttactaccttaggtcttttacagatgttgaaccatctacctgcgttgccttcctttcttagttagcatccctaggggtctctgctcaaaagacaaattatccgaaaaggaccttccctgaccactctgtctgaactccccacccgcactagtcattagcacattattctgtcatccttcagggcaccttccaatattatttagctattgtctatctcccctaatgtctctctggcacctagcacagtacctgtaacacagtaggtacttactatatatgttactgaatggaaaaattaatggaagctgaatctatcagatgaattccaaagtgaattctttttagagctagaatttgtgaatgctatattagagaacacaaagagagcagaagcctttacaatcagctacccaatggggttgtggtggagctgcctcaaaactcacgtagtataagaagccttccttcatctacctgccaaaatgctcatttctcttcatgtgttccagtccccagcacctacattttataatattttatattatgtcaagactacttgtaaatgattgtgcatctctttcgagtgtgtctaaattttcactgagatgttcaccttctgaaacataggagctgattttccttatttacatatcccagcacaaccctctgcacacactgagtaatttagcaatgttgtccagtggctgacagaccaaaggggaagtgacccttcaaaggaagcccacatcgccacagcgggggaagcacaaacacagtatacccacctgcaggagctgagtcctgagaatgcaaacatttcccacaagataaagccgatcctcctgaggaacacatgcagcaaagtcagcacagaggtggctggaaaacaagccactaaagaccacaggaaactctaaggaagatagacacacatgtgaaaacagaaaggtggaccagttaaacaagaagacaaatacctgacacatccatgtgctgtttgctaacccattgacaattttcaaaattctgagccatgggatttttcctgtcttctttccttttcagccaccctccccatcaaaacataaagaatttattactgagaatcaaatattgagagttaaggttggttttcagtcttccgttattaccctgtggatggatattttagtctccaaaagagatgtggctcctctcttttatatagaccatatgggtagagtgtgtgggagtgtgtgtgtgtgtgtgtgtgtgtgtgtgtgtaatctgtgcacacagagtcaagtaagattttttcaaaaggtatgacttttaatttccaagaatcatgacaaatatatcagccaccttttgcgtgagttaatttcatttatttatttattcatttctcacatgttcatcaatatttggtattattcaaacttctaatttttcccattctgatgggtgtagagtgctaatgtcactggtttttaaatgtttcattctttgcttattagtgagttggagtatcttttcatatatttgttagctatttgggctatttacctctgattcaagtcccagatattttaatggctccaaaccagttaatattaattaatttatgttaatttctcagcttgcagtttctgaaacctcaaaatttgtaaaatggaccctatatccacacgcgacaaaaatttgggttttggtttcttgtaaatggcacattttgtccattcaaattcccagagagatgataaacctactcactattcctctgggtcaatggacagaactttattgatcacttcattgatctctaggttttatatactggtgcttgactgggtgttagaattcccgaccccagccaatggagcctatgcatgacttaaaatccaccgaggccaccacaaaatcagctgcttcttaccactgtcatactgctttaaactttaatttctggtacacatagacccacagagtcccctttattttaagcttggatatgcattaaacttcttttgttatatttttgcaatcatttccttgttttataaaaagaaagagccatccttaacaactcagtgtcccccaccttgtaaatttcactgttaatttttaaaagtctaagtaatgtgagtagtcagaaactgtggccatagggatatcagacagtttgcaagtaccaagcagaagagcatttatgttagtaatgtgaggctacatgactcataaatgtcatatagataagataaacagaactgcttaccattacaaatatctcttacattcacaataaatttcacgttttcgtaagcagaactatcaccatgttcgacatttcctctttttaaatgacagcaaaattcaatatgtgtttctagtaaaaagagaagaaatacaaaacaagtctacatttgtactttaccatattctactggattatttcatatgaccaatgtctttcttcgattagattttacaaaaatattattttctttccacgaacattagcacttacatagctagctatgttgtatcagtagagtagggcaccagctagaacgctatatacaatggtccatcatttatatagcactaatgcaattgtacaaatgctacaatactcagggtctgtggtgaggaataagatttaatggaggagagatttttttaacactagaaatagagtttgtaatattatataaaagtaaattaatatatgatcaacagccgtatgtgctctaatatctttttagaaattaatccattgagcgattgttacttgtcccttaaaacctaagaatttactacttttaaaaatatacatacctgagtttagtaaaggaaatttgagaataatcttttggtagacttcatctttctcttcatcaggcagaaggcttaataattttttgcccacaatctcagcctggcaggagaggagaggaggaggtggagggaaaaaggaggggaagagggagagagtaaacttttttatctgtgttaatactgttcagttcctctatctccttacctccagtgagcttatgctctgccccacctcagccatgtacagttatacctgttgtacctctaaaaaatacaattcccattatcctactttatgagcaccacctcctatgtgctctttccctctaccatatttgcctgggaaaattttgactctagttacttccaacctttcatttatctacaccttcacccaagcaattgaatgtaaatgaagaaaaacccacaactaagcagtatattatttgaaataagtattcaagtctgcccaaaaatcatttatttagacaatttgctcccctactctttttcctccttcaaacctccgacccccgagccttccttcattttcagctgacctaatttcttgtttcagtgaaaaaaaaatgggaaatgtcaacatctgacaccaaatctaccaacctatctgttcctgtgcctagagacctgctttccctcctcttccaatgaataagctcctacctgaatttcactccttcacctgtgcactgcatcccatttttctgtagactatgaaaagacattgttctagaaagtctcaccctaccccacacatcaagttttctttccctctcaactgggtgttcccataagcatacaaaatgctgtactatacatgctatgatatctgtcatctatttggtcattacacactctatgcatgtattgaaatatcacatgtacgccatacatatgtacaaatattacatatcaataagaaactttaaaaataatcaggaaaacaaaaacaacaacacaaaattctaaaaacgcataaccttcctttacattaccgcctctcccttcaattataattctacttatctggagttatgtacaaatttatacatgaataagaaattttaaaaataatcaggaaaacaaaaacaacacaaaattcgaaacatgcataaccttcctttacattaccgcctctcacttcaattataactctgcttatctggtccactttggaacaaaaattcctgaaatgaaacgacacttgttacctcccctttcttcacttctcgctctttcttgaaaccacactaatgaagtttatatctaaccactccactccactgaaactgcttttgtcaaggtcactagtgccctccatattgccaaatcaaatcatcacttctcagccctcatcttaccaagcgtctcagcatttgatgcaattgatccttccttttcccttgatacatttacttgacttccaggacaccacacacatgaggatatacttctacctcaaaggctactccttcacaatttgctagatcttagtcttgcttcctgaatactaggcatcggagtgccagggcttatagtcattaggcctgtttccctacgtggtctcttccacttccatctcattaaataccacctatctgttaatgactcacagatagtcgtctcttgcccccatgataactcaacttggatgtctaatcggatttcaactttaagatatccaaaaagaactgatcttttctttgacaaaatatgttcctccctcggtcttcccaatatcagtaatggcaaccaccatttacccatttacttgtccttgacttgccttttatctctcaaactcaatatccagtccatcagcaatctctaatggatcaattttcaaaacacatacaggctcagttcacttttcgccacttggtccaagtctcatttccagtttggattactgcagtagccgtaactgctctccctgcatctattcttgccatgcccctgccaccactccattctctatagaacagccagcatgattctttccaaacatgagccacatcatgctattcctatgctcattccaaattttctactgattatccaagtcattctgaataaaagccaaagtctttataagggctttcaccactctatattctggttccttgctgctattgaccttatctgctttctctctctctctctctcactgcactccaggtacacccaactcctcattcacatccaaacacaatgagagcaaatactcatctcagagcccttaaactaactcctcctgaaatgtgaagcactcgttcccaaatatttgcaatggctttctctctcacttaatacaggtctttactcaaaagtattttacatagcaccaactccttgacattctcttattgccttttttgttatctgtttattatctaccttccccattaaaatgtaaattgcagtataacagagaccttgcctgtcttattcattgctatatcttcaacacctagaacagagcttggcactggtaagcactcagtaaatattggttgaatgaatgaataataccgtatcatgtagctgaaatacggtgagacatggataaattgaatatcagatatagaagtaatgaggctttaatgtgatagcaacaaagtaataaagtattccttgtagctgaataatggctttgtgtgatgaaccacaaattccaatgattttttaactgattagcattaataatctacagtcactatttagaaatatatctttatggcccatttgtagaagccagcctatgaactggtcaatgatcaaattagcagacagatgctgtctcaatcaagcttggcttgattaaggatagaaatattaccttaatctagcaaacaaaacattatggaattaacaggcaatacatcttgacagtgaaagtcacacagtaaaatactgacttcccaaaagaaatgtagatttttttcactaaatttaacttttcaataaaaacacttttgttggtttagttataaaatagactttagatgccaaactgggttacctctgtggagaccactcattcattcactcatctaacacacgataaacaattgctccatgccagtcactgttctaggtatgttcacatatacaagctcacttaatcccctgggagagtaagaattatcccttgttttattcatcagcaaattaaggcttctccaattgttgagagttcagaaatgcagaaatgaaactgacatgaaagctccatccaattccatgtctattgttccttttactacaccatagctgcctcaagtccagtttgcatcaggaacagaaaatttgctactggaccagttcctgtattttggacattctacatgaagtaattcactgaataagattttatacttatttcttataagggttacaaaagatgaacctgacaacgaattccaatgagcacatagtctagtagggcagattaaatatgcacaatcaattatgatgtagagtataaaataataccctaacaagaggtacaaagtgctatgtctcgtaagttctttcattagttgaaaaatgaagatagcattgtcacttaaaagagttcaaagtgagctatcttttgatagtctacattctcttggatgtgactagtggtaatgagtttcttattgcctctctagggataggaatagtgacaataagccttataattaaccgctaattgaaacactggatctgttccagtggccttgttccttagttagaaaaagggaggagacctgaaagcatgatcgacctcatgttatttttgtaaatttttagcatttgctcttcttattacacaaggtagaaagatcaaggtacttagagcttaatgaagcaaggataaataccagcgaaaaactaaggtggtttttcaaaagccaagtttgcaaatatctattagttgtcacacaaatattagtgtggtgagtctcagtcacgtcaaaaaaagaaagaattaagaaatttactgaggacttcatgacatttactgagaacctaggcaagaagcatcttttttcctgccaaagacactcatattatacatgcattagaaaactattcaactgtatagggcacagggaaggataagatcctctgcaggagatttaggcagcatctcaaatcaaatgagactcatcactactaaatctctactatgcggtaagcttctcagggaaaatagggcaaatctcatcacagttatcacaaactaaccatgtacctatgttcaaaacctgctaagttttaatctcttaaagattcaatgctgagaattttttcagatgtagtgtacgttttaaaagtttcatttgctttagaactgcaaaagagaataaatatatgtaaactcccagatttgattttattttcagggggaatgacagagtagggtgagtaggagggcaggctgctaagaacagggggcagtgactggaacttactactacaaatgactatgagtttttccaaaggaaaaaaaaaactgtcaatgaaatcaatgattgggaaaatatgatggcaggtttcagataaaagtttaataccatgatcatgatgataatgggcatcattttattcatggtatgtgttgtaacagcataacttggacacatcttatctctgtgtcacacccctcttccaatacatcagcaaaacaacttattttacctacaaaatgcttccactgccacattaatccaacccactaccatctatggccctccaagtggactctgtacttccatgcctgcccctcatagccaattcttgacataacagccaaagcgattctgataaaacttaagttagatcatttctttcatctgctccaacctccccaatggcttcctcccatctcagaggaaaagggatgttacttctcctgttactgctctgactttatcatctctattttccttttgctcacagcactccagttacactgtcctctttgctgtaccttttcctgctttcaggctcttacataagcttcctcctctgtctgaaagacacttgctccagttacctgcatatcacacatactccattcaggtctctgtataaatgtcactgatcagatgggccttagccaatcacgttatttatactaattcatctcccagcactctctaagtaatattatttccccacttatagaagagaaactaaaggtcaggcagttagagagaaacaaagctaaattttaatctctagattatttgattccgaagaccaagttctttccatcacaccatgctattagtttggagttgctccatagacagaggtgccctgatatgtaatgaaactgaagattcctggagccacgcagacactctagaaatggttcagtctccattttataatataagttggatgacttataaaatgaaatttttaatcaaagcctgagaaaaagattgcctgttttgaaaaattaagaacagttgggattcaatgaggaagtgtgaaactatgcctcaggtgtagtcgtttttaaccttgttttataggaatatataacttaattcccatttaatgtttatgtacaaatgtaatagttatacatttatttttaagtacactgatctcaggtaaatcaagtctattgtttaaggctggcagttcaaagcacatgtcccagacacctctctagaccttgtggttttggggggcgtgtgtgtgtgtggtacctcaaatgttgaagggtgaaagagcttcttgatagggaaaactttgaaccaaatacataaagaagcaagatcatatcataactaacaccatcactatgataaatcttcacataataagaaaaagtcaccagtctcagccaatgaccaatttggtttaagcaatatctgatgccacaagaatttgggtggttttctggtcttcattataataaaatttaagctgtagtggatcatactcgtacattccctcttttaatatatattttaaaagactcttttccttctatgatttaaatatactaaagtgcaatccaataaatatctctactatttcatttagctgttttggtatcctacaaatataagctgaatttggaaatgtaaactgtttttttaaaaaatgaaagagaatgagaaataaaagagatcgattctagcatctgtaattttttttaaaagggtataaggactctgagcttccaagaaggccacggaacatgccaactggcctggctaaaatagtgacatatttttaatccacttccaacctaactacaagataatctaacctagcttctattaatttccatgttccaaatttgagtactatagatttctggattagggtttgtcaagttcttgagacaactctgtggaatgaggaatatgtaatgaaaacaacaacggagatatgattgttttacactactaccattagtgaataggggtttcaatttcttcatatcctctcccaaaactttttgctaacacaaccatgccaatggcagacagtttgtgtgggagggttgttggtaaatgtattctaggtaacccctcttcaaacacacgtataagtggaatatgaaggccttgctacagattgaatgtttatgtcccccaaaaatttatatattgaagtaatctagctgtcaatgtgatggtattatattaagaggtggggcctttggagatgattaatgggattagtatccttataaaagaaacccctaggctgggcatggtggctcacgcttttaatcccagcactttgggaggccgagatgggcggatcgcttgaggtcaggagttcgagaccagcttggccaacatggtgaaaccccgtctctattaaaaatacaaaaattagccaggcgtggtgatgcgtgcctataatccctgctactcaggaggctgaggcaggagaatcacttgaacccaggaggcagaggttgcagtgagccgagatcgcaccattgcactccagcctgggtgacaagagtgagacccaatcttaaaaaaaaaaaagagctccctcgcttcttctactatatgaagttatagtaagaataaggatgtctatgaagcagagattgggccctcactagacaccaaatctcttggcaccttaatcttcgacttctcagactctaaaactataaaatataaatttgtgttgtttacaaagacacccaatctatagtactctgaaaccaatggaaatgacaataaaacagggacacattttgacaacattgaaaacatcttctctgatgagctttatgcttctgaaaataccccaaaacctccttaagctgataagcaatttcagcaaagtctcaggatacaaaatcaatgtgcaaaaatcaccagcattctcatacaccaatatcagacaaacaagagagccaaatcatgagtgaactcccattcgcaattgcttcaaagtgaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaaggactttcttcacagaattggaaaaaactactttaaagttcatatggaaccaaaaaagagcccacattgccaagtcaatcctaagccaaaagaacaaagctggaggcatcatactacctgacttcaaattatactacaaggctacagtaaccaaaacagcatggtactggtaccaaaacagagatatagaccaatggaacagaacagagccctcagaaataatgccacgtatctacaactgtccgatctttgacaaacctgacaaaaacaagaagtggagaaaggattctctatttaacaaatggtgctgggaaaacgggctagccatatgttgaaagctgaaactggatcgcttccttacaccttatacaaaaattaattcaagatggtttaaagacttaaatgttagacctaaaaccataaaaaccctagaagaaaacctagacaataccattcaggacataggcatgggctaggacttcatgtctaaaacaccaaaggcaatggcaacagaagccaaaattgacaaatggaatctaattaaactaaagagcttctgcacagcaaaagaaactaccatcagagtgaacaggcaacctacagaacgggagaaaatttttgcaatctactcatctgacaaagggctaatatccagaatctacaatgaactcaaacaaatttacaagaaaaaaacaaacagccccatcaacaagtgggcgaaggatatgaacagacacttctcaaaagaagacatttatgcagccaaaagacacatgaaaaaatgctcagcatcactggccatcagagaaatgcaaatcaaaaccacaacgagataccatctctcaccagttagaatggcgatcattaaaaagtcaggaaacgacaggtgctggagaggatgtggagaaataggaacacttttacactgtcggtgggactgtaaactagttcaaccattgtggaagtcagtgtggcgattcctcagggatctagaactagaaataccatttgacccagccatcccattactgggtatatacccaaaggattataaatcatgctgctataaagacacacgcactcgtatgtttactgtggcactattcacaatagcaaagacttggaaccagccaaatgtccaacatgataggctggattaagaaaatgtggcacatatacaacagggaatactatgcagccataaaaaaggatgagttcatgtcctttgtagggacatggatgaagctggaaaccatcattctcagcaaactatggcaaggacaaaaaaccaaacaccgcatgttctcactcataggtgggaattgaacaatgagaacacatggacacaggaaggggaacatcacacactggggcctgttgtagggtggggggaggggggagggatagcattaggagatacacctaatattaaatgaagagttaatgggtgcagcacaccaacatggcacatgtatccatatgaaacaaacctgcacgttgtgcacatgtactctaaaacttaaagtataataaaaaaagaaaataaataatgaacccctaaacaacaaaccagaatgatccactttcccaaaagtagaaagaacttactggtaaatgtccaagaagagaagagatgttttcagccacacaaatgatcactccatctgtgctcagtgtaatcataaagccatctaataactaatgacgagagaataataatgtaattaaatagtggaacaataataaaatgatagttttattgctaaatgcatagataattataatagcacactgaaatgcaccccagtccttaaatatcaataaagtaggcacagacttaattaaaattccattattctgcctcctacacagaatctacttaaccttaagcatgaaatgtttatcaaatgatgtgtcacttaaacaaatttcaatgtacacccaattaacatgaaattctccaatgcaagctaagaagattcatttccatgtgtaggttgtttcactttaagaacacttaatttcaaaaatgttaaaaatattttaaggacactttcatttgtggttaggttagtcatctccttataaatatggatattgccatcactttcctgctgtatgatggattcaatagccagacaaatgcctcctggtagagaatatctaaaatgatgaataaaatagattaaaacttatttttcaaaacaggaccaagctactggtaaagtaagggaaataacctgatatcagaaatgactagattgtgagaattaagacactggagaatattagaccctgtatttgccttgagactatcttccaacactgatagcctagagcttgggggacaaaagcaaagccgaggcctgtacaaggtaggaggtgaaatcaaagaccacagtacaaagccaggtctccaaaagggagacactttcaacaggtaaaacagaaaaatcttatccagtgaaaggagacagggaatgtgcatgtctgcctcagcctccatcctgggaagagtaggaaaagagaaaatagtcaactttaggaggtactaagcagaagcccaccttcacacaaacttggagctagaattcatatactacctgtgtggccctcaacaaccaaagtctaatatttagtttaaagtgatcctgaccccatatgtctaataaaaggaaatcaaaatcacatctagagaattattttaaagtgagggttcaaagaattcatgtagataaaattacaaataatatgagcttataataaaaataaaacacaggaagagatgaagcattacgaataagaggcaacagacataataaaataaagaatcatatttaaaaataacttattggaattatcagatacagaatacaaaataagtatgcttaataggcttaaataaataacacagggcactagaaatatgaagaaacaagagactcaaaactgactcgtgagatataaaacataatcaaacaaaatgtctatagatgatattgtcatcaaaattagaaacttaatgtataggttaagtagcatgttagaacacagccagaaataaaatttttgagctggaaagagctgaggaaatgactcagaatgtaacacaaggagatacaaatggaaaaataagataaattcatttcatggagaagagaatcagaaagtccaacatatgtctgatcagtgttcctgaaggagataatataacagagaagaggaaatactcagtgagatataggtggaaaattatccagaagtaataaaatacaccaatcttaagattcaggaagcccaaataattgaagcaggattctctatttgtataaagtcatgaactcctcaaacccattaggatgggctatgattaaaacaaaacaaatagttttgggacaagatatgaagaaattgaaacccctatgcactattgatggtagtataaaatgacaaagctgctatagaaaactctacggcagtctctcaaataactaaacatagaactatcatgtgattcagcatttccacttctgagtgtatagtgaaaaaaaaaaaaaacaccctgaaagcagggactcaaacaggtatgtgtacacctatgctcacagaagcattattcataatggccaaaaggtgtaaacaatctaagtgtccaacagatgaatgtataaccaaaatgcgtaacaaacaacaaaatattattcagccttaaaaggaaagagaattttgccacatactacaacatggatgaaacatgaagatattatactaagcgaaacatgtcacaaaaggacattactgtatgattccatttatatgaagttcctaggatagccaaattgatagatgcagaaagtagaaaggtggttaccaggaactgggagaaagtgagaatggggagttattgtttgagtacagagtttcagttacgcaagattttcaaagctggaaatggatggtggtgatggttgcacaataatgtgaatgtacttaatgccactgaattctacatttaaaagtgattaaacggtaaattcgtgttatatacattttaccgtaataaaaaaataggccaaataataagtaataatggagattacaaagtatttataatagaataattttttaaacactatttattgagacctgtgaaaagcagctaaaacaacacttgggaatcttcgcctaaatgtatatattagaaaagaaaattggttacaaatcaatgaattaaataatctaaaattgttagagaacaaaaaatgaaccccaaaaagtagaaaaaagtaaataataaaaataagagcagaaattaataaaacaaaaaataatgacacaatggacagaatcaagaatgttaaaagtcaattctttgaaaagaacattaaaatcgacaaacctctggtaagatgaatcatggggcaaaaaacacaaacaatattaggagtgaaaagtggatatcattacagaagctttagacattatgaagataagagaatattatgaacaactttatgccaataaatttgaaagcaagtcttaaaaacatataaattgcaaaaagtgacttgggaagaagtaaaaaatataaccaatcacatcatcattaaagaatgaaatcactagtttagaatattctcttatctttgtgatgtttctccttcatggcatacacaagaaataactcaaaaagtatgaacacattaaatataatagataaaacgttaaagcttttaaaataaaatataagagaatatatttattaccttgtggtaggtaaggattttttaaacaggaaagtaaacaccctttgattggtaaatttgattactttaaaattaataatttgtcaaaagtcaccttaaattgtgaaaaggcaagctacaaactagaacaagaattttgcaacacataactagcaagtgattcgtttccagaatctattttaaaaatctccaacatatgaataattagaaagaacaataccataagaaactgagcaaaggctagaaacaagcatctcatagaagaggaaacacaagtggcctcaaaattggtgaaaagaggctcattgtcatttgtaatgaaacaagacgccattccattcccacccaattgacaaaaatttaaaaattagacaataaattgttagcaaggatgtggagcaataagaactttcatccactactactaagaatataaaagaacagtgaaatacacagtgaaacagagtcacttgaaaagcattgtcattttcatgtagagggagcgaccctaccactccaccctaccctccagcaatctcactcctagacatacacctagaaacactcttgcttatatggaagaggatatatgaacaaaaacgttcaaaccaaacctgctcacaataacaaaaacctacagctataccagactcagtttatgcgcctcctcaagattcataccccatcccaccctcaatcaagccagggatgttagctttgcttttgcagtcccaacctagtctcctaactccgccagcactaggtgcttcagtatccatccaaagggactggattcatgaaggcagtaacttcatccacctcggagcatgggatctgggttccccattgggtttccagaaaagccaggtaacccaaaggacagaattgctaacatcctgggtgtgacttttgactaatgacaggagaaagaaaggaactggtagatacagtattttcccttcctcccctatacagactatttcaaggtgtggtgccttttacatagttttaagagtgactgaacaacccgctgtgtgttcttgtgaagctctatccagcttggtaataaactaccctatatttcagttcccttcttccctgccttactttccccctcaccctcgctatcctgagattgcatatcccactaaaaccttagcatataaattttgcttcagcctctacttcctaaggagcatgagctaaaacagatttctagtgcccatcaacagcaaaatgggtaagtaattgtgtagtatgttctaacaagaatacagaagtaaaaatgaatgcactagagttacatgcaatatcatggatgaattgaaaaagaaaggttgagcaaaaatatcaagtcagagaagaatacatccaatataattccatttatataaaggtgaaaatcatgcaaaagaaaacaacatatcacttagagatgcatacacatgtcctaaaaatacaaagcaaagcaaagaaatattgatacagaactcaggaaatagtagggaagaagtggtgtggaagaagaagattacgacaaagggatttcaaaggatctggtaatgctctatttcttaagctcggtgtcacctgtactatttttttaagtgttactatatgttatgtatatttttgtaagataaaattttaagtaaaaacttttaaaactgggtgtttgctatttcccattagacatcaaaagatgacatccaaaattgccacatgcctgaagtgacctcccaaacacataggttcagaaaagagtctaggcagatctggtaaggcactttgcttctctactcattttctgtatgtctgcttgcttttggcattttgattaccacattctctactgagacggtttgctctgagttagtctggacccccatgggctggagtgtaagtgagaaaacatggtgtgctactcggctgtgctactcaacaggtcttggatttgggcaaggtgcaagctctcccagctttggtctcctctttcctgcagtaaaagggatcaacatcattattaagttaatcataggcttcttatgaggatgaaatcggctactctacatgagagcacagtgtaggttgttatgcagatgtcaggaggctgttacgtttgaccaacagtatggcaaacaggaaggaaacatccaaagctaagtcactgctctgaaatacaagccataagaaacaaagtcaccttgctctcttgccctccaaaccccgctttctttcatgcttcaaaagaatggccaaagctgtaatgaaactggaaagtgaagagaaagagccctctactgtccctcttctcagattccctgatgtttccatctccctggttgaagtcagctctgattagccagactgggcttgtttatttcaagaaaaaacttcatgaataaagaataaagaacagacttttctagggaagttattaaagcctaatggaggggaaaaaagtggaaaggagggaattacccaagaaattctgatccttccacttgaatgccatatgttctgtagttgtgaacataattatccctctagggtgtatttataccttgtctagcttctaaaatatttcaaataagcatctggtttcataaaattggtaacaggatttcacataacacattttaagtcctctatttagcaaatatttgtgtataggattcctaaaacaaaacctctaataaaattgagagagagtcaggtgcagtggctcacgcatgtaatcccagcactttgggaggccaaggtggatcgcttgagcccaggagcttgggagaccagcctgggtgacagagtgagatgtaatgaaacataatgagctgaacatagtagtgtgcacctctggtcccagctactttgggggctgagttgggggaattgcttgggcccagaagtttgaggctgcagtgagccacaatcacacaactgcactccaacctggatgacacagtgagaccctgtgtcacaaaaaaaagtgagagtctgtttcttaaaaggaagaaaaatgaagtagaatattacaatatggctccattcattcacagtcagaattttgcccctaacattgggataggtttgaaaagattcactcacacaatgcctttctcacacacctttatgaccactaatggtcatagtgctgggtggtcagccagtactgaaggagaaaagggactggacggataatttccaggcgtctaatattgccaaacgctgtactatatattttacacatgttcactttattttattctcacatcatctcaatgagataaagataatttttacccattttaaagagaaagaaatcaaggctcagagatggtaattcagtcaagacatacagcaagtaagggacaaaggcaaaatctgtatccctgtctgtcccactcaaaggaatatggttcttcagagtgcagtttgtggcttgtgaaactaaccagttctcttggagacagaaactataaacaccttacattcttgaggggggagaaactacttgaaggctaattcattagagtataaccatctatgttgaactagtctaccagataaccacttaacttgccactaacctatgcgaagacttgtttgtgtttgttgtcactcaaaatcagtggttctcaaaactcagttggcataggaagcatccagggagcttgagagaaatgcaaactcccggccctaacaggtttgagagtctgattcagacgatttaagttatcaagctccctggttgattctaatgcatatgatctcctaatcacactttgacaaacactattctttgtcttctattacatgtattcaacatatgaagtaatcaaagaacaaaagccctcttacctgtagcgtcacttggttgaagtaatcataggtaggaaatgatggaatccagtttaatttcctttgagagctttttggattgactttgtctttttagaaaaaggaagaaagtacagaacagtgtcacattaaaatgattagctatgggtattagatttttcaaagttatacttaatttatagaaaagactcttatgagaaaatgctgagtgctaatgaaggatctgatgttggctaactaattgtatataaatgatcataaacccagaagtgtttggaattgaaaaagactttgaagatcatccaactcaatttctaccacacacattatgacctgtccaacaattttatgatttttcaacttctagttctttttttcctcttgaattctaccaaaacccagtatccataatctgccaggtaagtcaaggggttctaagcagatccagactcccaaagcccttccctagtcctaactaaattatgaaattccactctttagcttcatctatttaagctttgcacaaggttccttaactagaatatcttcaagccttatcttttatctcttcaaagctcctggtactgtcctctcccccatctgtcctatcacattcttcagggttttctggtttcctcaatgagaagtgtgtttctgctcctgtgcttagtctttgctgtcaacatgtgctcctctctacctccccaactccaccctactccactaacttcactagcaaagggacttcactaacacagccctccaatctcaagtgattttaatgcttcatgtcaataaacattagttccttctcctcacagaaaaatgagacccatagcatacaactttgatctctattaaaaatgtaaaatcctatgacaaggataatgttgacagtggctattgctttcttgacaggcatgagtctctgactctttcctaggagtagagttgggtaagagggaggccatgcataaagagagctttagagccctcactgatgagggaatgaaaatagggtgtgtaactgggtgtgaaataggagtaacatgaaaagtaaaccatgccaactgcataaatgagtcaggatcagtgatcctgaccactgtcccagcttggaaactcaattctaggcatagctcttcaaactcaagaaacaacccatgacactcttccatagtcaatttctgaagaaatttctccattgccttccagttccatctcataactttcatctcctagacttcattcaaagaaataaaaaagagaggggagttcatatattgccaagaaaggataaccactgtattttataaataaatcataaaggacttttctactttactattacccatgaacttgtttttgtttattctctaaggtgtgcatcatatccagttcttcatcatatccccaacgtctaacatagtacttaggtcatggcagggattcagtacctgttgttaaagtgaacctcttttattcatttatttaacgaatgtttacagagctcctgctatgggtcatattctgctttacaggtttaggatatagcataaacaagaaaaataaggtgactgttcttttgtatcttacagactgacggggcagcgtagacagataatcaacacatagacaacagaacagacagtttcaggtatctgcaagtacaataattcgtaagatcgggtgatcaagaaaagccttactaggaaggtattaggaaggtaacatctgagctaagatttgattgacaagaaagcaaccatgtgaagacacgggaccaaaccgtctcagggagatgaaacagtaagtgcaacatgaaacaggaaatcattttgcctatttaaagagatgacaagatcccagagtggctgcagtgggatgaccaggggttaaagcagtaggaagtgaagcctgagagacaggaagggccagatcatgtagggtatatggtaagaagttggtattttatgctgagtaaaacatgaagtgcttttaattcttcttcttcttcttcttattattattattattttgagatggagtcttgctctgtctcccaggctggagtgcagtggcgcaatctcagctcactacaacctccgccttccaggttcaagccattgtcttgcctcagcctcccgagtagccgggactacaggtacctgccatcacacccagttaattttttgtatttttagtagagacggggtttcaccacgttggccaggctggtcttgaactcctgacctcaggtgatccacccacctcggcctcccaaagtgccaagatgacaggtgtgagccagcgtgcccagcccatgaagtgcttttaagcaggagagtgacatgttaggtttttacaagatccctatggttgtttgttacaaacagaataaagtgggtagcaaagatagaggcagaatctagctatgaaccttcatcaaaagtaagagatgaaggagtggggagatgttggacaaaggatataagatttcagttagagtaagttcaagagttctattgcacatcatggtgactacagtaaataacagtatattgtacacttgagaattgctaagagagtagattttatgtggtctcatcagaaaaagttaagtatgtgaggtaatgcatatatcaattagctggatttagccattccacaatgtatcaaatgtatccattggataccacagatcatactgcaaacttttgacaaaaactttttgatcagtgtacttgaatttattttagaagtttgatctggaaaagtaagttaatttatcttctcaaacacaaatgaatttaagctgtaggcaagccaaggctcaaaaactgtcttctaaaaatatcagggactgtatacttgtcagtcatttgacaacccttagagtcagctctgggcaggcactgtgcaaggcatggaggacacagtttgaggaagagggctgtcaggtaaacaggtgatgtgctaagtattataatagagctggagctgagagttatgaaaaaaaaacactggagaaaccacatttctctgagtgaatcaggcttccctgaggaagtagcattttgctagatgtgaaacgggaacacaggacgagggagagggctttgacagaaatgtcagtcagttatgaatgcatacctcttctcttttcccctctcatcttcattcattattcagtgacgtaggaagactcctgaaatcaaagtgaagcaacattttactaagagatcagtctatggtgaatcacagtaaagcaataagactaatcaaaattctcaattgtgtaacacttttccctcaaggaatgtctacttcttttaaagataggctttcattaagtaccaataacactctcatatgttatgtagatgttgaagacttgctttattgcataatccccaatgaatatttttgataataacattacaaatgaatatatttgtaaaagttacaaaaacattctgtggttacaccacttaaccaaaaaaaaaaccaaatatttgtattttaattccatacccttaatttgtgttttaattccatacccttaaattcatttaactttcactaactttgagaaaatttaaggaaatgaagacagatgcagtttgaaagcttcatgccaagcgtgtacatgccacaaaagggaaaaatttgcattattgttgatgttcacagaaatccttgacatataaaacaatagccctgaaatcactgaagtcctctgctttgagctatacaattagactcacacatcacctcaaggccaaagcctcaaggtagatgtcaatggcatcccaatacatatgtgttacaaaaaagtgattaaaatatagcaaacatcctttaaatgttctctaagtaagggaaagttcagggagtcaaacactggaacggtactgagcacaaaatatgaacccgtgcttggtgttaatgctctcctagataaaaaataacctgaacagggaagtgaaactaaaaatcaccacctctccctatgtatagccagaactcccagaggctaacattacattgaaaagaaaaattggataaaaaataacccaaacagcgaagtggaattaaaactcaccacctctccctacatgtagccaggactcccagaggctaacattacattgaaaaaaaaaatcctcctaccaacaaaagaagaaaacaggaagcttgtctgtctcagcatgttctctgggtacaggagaaaagacaccaccatactgaatcaaccttggggttccagaaaaagcaaagataaaccccttctggagacatactttctaaagacagattccacagaatttccacaaataaggcactgttgaagatgagctcaccattcaaaattagaaaatacataaggaaataatctctccccctccccctccccctctctcgctcccgtctccctctttgcacggtctccctctccctctccctcgtctctctctttgcacggtctccctctgatgccgagctaaggctggactgtactgccaccatctcgactcactgcaacctccctgactgattctcctgcctcagcctgtcgagtgcctgggattgcaggcgcacgccgccacgcctgactggttttcgtattttttggtggagacggggtttcgccttgttggccgggctggtctccagctcctgaccgcgagtgatctgccagcctcggcgtcccgaggtgccgggattgcaaacagagtctcgctcactcagtgctcaatgttgcccaggctggtgtgcagtggcgtgatctcggctcgctacaacctccacctcccagccgcctgccttggcctcccaaagtgccaagattgcagcctctgcccggccgccaccccgtctaggaagtgaggagcgtctctgcctggctgcccatcgtctgggatgtgaggaggccctctgcccggccgcccagtctgggaagtgaggagcgcctcttcccagccgtcatcccatctaggaggtgaggagcgtctctgcccggccgcccattgtctgggatgtggggagcgcctctgcccgtctgccccgtctgagatgtgaggagcgcctctgcccggccgcgaccccatctgggaactgaggagtgtctctgccccgccgccaccccgtctgggaggtgaggagcgtctctgaccggccgccccgtctgagaagtgaggagcccctccacccggcagccgccccgtctgggaagtgaggagcgtctccgcccggcagccgcccagtccgggaggtggcgggcagcccccgcccggccagccgccccgtccgggaggtggggggcgcctctgccctgccgccccgtctgggaagtgaggagtccctctgcccggccgctgccccatctgggaggtgtacccaacagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccatgctctctgaaacatatgctgtgtccactaagggttaaatggattaagggcggtgcaagatgtgctttgttaaacagatgcttgaaggcagcatactggttaagagtcatcaccactccctaatctcaagtacccagggacacaaacactgcggaaggcggcagggccctctgcctaggaaaaccagagacctttgttcacatgtttatctgctgaccttccctccactattgtcctatgaccctgccaaatccccctctccaagaaacacccaagaatgatcaataaatactaaaataataataataataatctatcagtccccaaaataagggacacacataccccaacagtatgaatcccccaagaacttcaaatagatgtggacaaagatgaattagaaattatataaatagatatattcaatgaaactaatttttaaaagatggattgaacaatgtattagaaacatcagatagggaaattagtaagtggaacagagctatgaggaaacttgccatacagtaggagaaatgggttagaaaatatgaaacaagaggttatgagacatgaaggacaaaatgggaaggcacagtatatatctaagaggggttccagatgggcataatagcaaggggagatgagcagtaaggagataattttaaattttccagaatggaaaatgtgacccaatctggataaatcaaaataaaaccacacctagaaatatcacagtgaaatctcagagcacaaaaaacagctaagccattctaagccataaaaaagatcaatacataccaaagaatattatcatatagaccatattttctggcccaaatacaattaaattagaaatcaataataaaaagacaatacaaaacctgatcgatttgaacattcaaaataacaaaacttcctaaatagctctgaaaagcagaaaatactcagaactaaagtattacaagtataccacatattacaaatatattaaagtaaaatgcagctaaagtagtaccaaagcttttagtcttaaatgcctattaggaaaaaaagcaaacaaaaactagtaaacaagttagtaaacaaaattagtaagttggccgggcgcagtggctcacgcctgtaatctcagcactttgggaggccgaggcgggcagattacctgaagtcaggagtttgagactagcctcggcaacatggtaaaaccctctctctactaaaatacaaaacatagctgggcgtggtggcaggcacctataatcccagctactctggaggctgaggcaggagaattgcttgaacctgggaggcagagattgcagtgagctgagatcgcaccactgcactccagcctaggcgactgagtgagactccatttcatacaaacaaacaaacaaaattaataaattagtaaacaaaataatttaaaaataaaagtaaagctaaagaaaggagaagaaaataatagataggaccagaaaataatgcaataaaaataaagataaaacagaaatcttaaaatgctttcttaaaataaaaagtagtgaaataaataaagcattgttatacaagattaatcaagaaacatgggagaggacacattttggaatgaaagggcatattataaatacaacatagtaaaaagcagtatgatcaacgttatacccataaatttgaaaacagagaaacagataaaatgggatactgccttggaaaatgaattttacccaaacctatttaaggatacaaagaaaacctgaataaactctacaaatctaaataaataaatttggtagttaaaaatccatccacagaaaataacctaaacaaatctaaacaaaacctgatgatttcgcaaatggatgcttctaaacatttagagaactgataggtatctcctatcccatgcagattacactagaaaacacataaaaagagaaattacccaatctattttataatgctagtatattcttcataccaaaccagagaaaggcagcatcaaaaagagaaattttatgtcagttttgtttatgatccatatgaaaaagttctaaataaattgtaaaaacccaaaccagcagggtattaagaaagtggagttaatccagaaatatcaggatactttcacattagaaaaaatatataattcaacatcccagttaaaaagagaaaaagcatgtgatcatctcagtagattcagaaaaacacatttgatgtaatttaatacacacatatgatttttgaaaatattcttaacagactaggaatagacaggaagttccttaacctgataaaatatgtcaaccagaaacatacaaacctcctaaaggtagaacattaaaggaattttttagcttcaggaaaaaaaagagtggttgcattcatgaacactctgattatctacatagaaaacctaagaaattctgcaaattattagaaataaaatagtccagcaaggttgctgtgtacaagattaatatttaaaaattaatttgttcctacataccagcaaccaaaattaggaaatatttttaaaacatacaatagcaacaaaaagttacagaggtctgctatggcttggttgtggtttcctgtctccaccaaaactcatgttgaaatttgatccttaaaaagaggcaatgctggaaggtggagcctagtgagaaggtttgggttatgaatggcttggtgccattctcctggtcgtgagttctcactctcttgatacaggattacttctcaggggaatggattaatttctgagagactgggttgttagaagcttaagttcctcctcctgcctgcctcactttttgcacatgtccccttccccttagactttctctgccatgttgtgatgtagcgcaaaatcccttgccagaagctagggccatccccttgaacttctcatcctgcagaaccttgagttaaataaaccccttttctttataaattacccagtctcaggtattctgttataacaacagaaaacagactaagacaggattgctgtttatcactctagaataactgatgtgggaacagtccccctgccatgaacaattaggaaactggacaaattataggaaatgcctgttctaagacactggaaagcaggtagcacatgcctgtgatctttgagataagagcaaaaatgagaagagctccacagaaatcccagatttctacctgagggcacttccagaccatgattgagggagaaggatctcaaccagaataaagtggtctcattaagttttaggaaacagacctaagagttcagaaaaccaagaaagatggttacaatttgtggagcagagtatcagaaagaagggagctctgggggaaaaagagttccagaaatctgcacacatgttttttgttttttgttgtgttttttgagacagagtctcactctgtcgccagggctggagtacagtggcacgatctcggctcactgcaagctctgcctcccgggttcatgccattctcctgcctcaacttcccgagtagccgggactacaggggcctgccacaacgccgggtacatttttttttttttgtatttttagtagagacggggtttcaccatgttagccaggatggtctccatctcctgacctcgtgatccgcccgcctcagcctcccaaagtcctgggattacaggcgtaagccactgcgcccggcctgcaaggtgacattctacaagaccagtcaaagatcaaaactaccagggagagaacaaatggtatgaatacaaaactaaataaccaccacagttcatgcctaggtggaagacatttgagttgtatccagccagagtagaggaaaaggagcagagtctctctcagtgtgggatggtatcaggcaatctaaaatataagtaactagattcccagaagagggaggcaaaaatattttttggaaaaataattaccaatttttttgccatactggatgaaaaatataaactcatatatccaagaatattggtgaacccaataaaataaacacaaagaaaaactaaaacaaattgctgaaaaccaattttaaacagaaatcttaaagcaaacagaaataaaagatacatttaatacaggaggaaaaataatgttttctctctggcttcccatcagaacaactcaaaccaaaagacaatgaaacatctttaaagtgctgggaagggggggttggaaaatcaacctagaattctacatccagcaaaaatacaccctttgagaaaactaaagatattttcaggtgaacaaaatctgaaagaagtcaatgagaagcataccagctttaatagaaatattaaaggaagtacttcaggtagaaggaaaatgatcccaggtggaatctcagatctacacaaaggaatgaaaagcactggcaagaatatatatgttcataaatataaaagaatgtttatcttctttaatttatttctataaaagataattgatgtaaaagcaaaatattctaaagtttataatatatgctgaagtaaaacccgtgacaatgatagcacaaaggacgggagggtggaaaatagaaatctgctgttgtaagcttcttacattatacatgaagtggcacaatattaatccatggcagactgtaataaattaaagatgtatatgacaaactgcctagacaacaaataaaaggcacagatatagattataaatcaaaaaagagataaaatggaatactaactaaaagctcatttaatccaaaagaaagcagaaaaaagaagacaatggaaacatcaatcaaataggacaaacagaaaacatatagtaagatggtagacttaaatcaaaacatactcataataatataaattatcagccgggcacggtggctcacgcctgtaatcctagcactttgggaggctgaggtgggtggatcacgaggtcaggagatcgagaccatcctggctaacacagtgaaacccggtctctactaaaaatacgaaaaattggccaggcatggtggcgggcacctgtagtcccagctgctcaggaggctgaggcaggagaatggcatgaatccaggaggccgagattgcagtgagccgagaccgtgccactgcattccagcctgggtgacagagtgagactccgtctcaaaataataataataatataaattatcaatgggctaaacacacaaatgtagtttaggattgttgattagatttttaaaaagcaagaccaaactatatgtatcgtctataagaaactcaatttaattataaagacacaggttaaaagtgggattaaccactgtggaagacagtgtgatgattcctcaaggatctagaactagaaataccatttgacccagcaatcccattactgggtatatacccaaaggattataaatcatgctactataaagacacatgcacacatatgtttattgcagcactattcacaatagtagtgacttggaaccaacccaaatgtccatcaatgatagactggattcagaaaatgtggcacatatacgccatggaatagtatgcagccataaaaaaggatgggttcatgtcctttgcggggacatggaagaagctgggaaccatcattcccagcaaactatcacaaggacagaaaactatacaccgcatgttctcactcacaggtgggaatcaaacaatgagaacacttggacacagggcagggaatatcacacactggggcctgtcaggggtggggggttgggggagggatagcattaggagaaatacctaatgtaaatgacgagttgatgggtgcagcaaaccaatatgacacatgtatacctatatatcaaacctgcacattgtgcacatgtaccctagaacttagagtataataataaaattttaaaaaataaaataaaaaaataaacttaaataactacaaaaaagtgggataaaaacatatataccactcagccctaataataaaagatttgggtgactatattaatattacacaaagtagactctaggataaatatatcactagggaaaagaagggacatttcataatgataaaggaagtcaatcaagaaaacttaacaaccctaaatatgtttacatctaactacaaagctttacagtgaagtaaaaacggacataaatgaaagaagaaataaataaatccacaattaagagttggtaatttaaatactccccttagtaatcaatagaataaataaagagaaaataagtaaggatatcgaagacttaacattaccagcaataatatttacagaacaccacatccaggcagctatggaacgtacattatcttccactgtatatggaacattcaataagattcaacatctactgtttcaataaatttaaagcattaaaatcacacagattttgttctctgaccacaacaggattaaattagtaatactaaacacacaaatatctggaaacccctcaaatatttggaagttaaatgtcatacttctaaacaatctgtgggtcaaagaagaaaccccaaagaaaattggaaaatatttcaaaatgatttactataaaaattaattttaaattccaaaaacttcaataatctaattgtaatttattaaaattacatttatacatctttatggtatatatttccatcaagaaaagttctctctctacaattattcaaacccgtttttcatgttcttaaataacatttataggttccttcatatagaaaggaaactatccagtgcttagtagctaatttaacaaaactgcacagaaatactacactagaaataataaggctttattgaatcacataaaataaatgcagtgacaatgcgaagtctgtgtaagggatgtctcaatatcatcaatttatcagatcttcccaactaatgtacaaattaacataattctgatcagaccagtaagtttttttgttttgctttgctttgtttttctatgtaacttcacaagttaattacaaaattcctgtggaaagtaaagggccaaaatacctacaataactttgaagaacaacagcaatataaagggtgtgcctactagacatcaaagcttattataaagctactgtattcaggctaatcaataatggtaaacacatacatatagcagagaagagacaacataaactgaaatttgatttatgataaaagaggcattaaaattttgaagttttaccatggagagagacaaaaaaagagagagagagagtatgtgtgtgtgtttaatatagccctttctgtgttttggggcaacaaaatttgtttacaagttctttgaagacaggagccatgctttacatatctttgatacctccaacagcacacagcttcacacagagcacacactcaaaatccacagataaacacctgaccactctccttacctactgggcaaggtaggctcaaacacctaactgctaatggactttgcaccttctccactcagtaattcattctaaaacaacagattcagaaacttatgtcggtgaaagaacatggaaagattgaaaaagaataaggctaattaaaagctctcaggccaagaatagtcagccctcctatgcaaaataataattaattggttggaaatagctgtttacataagtacatttttccaaaatcaatgggaaataatctaaaatcccatcaaattgtattactgaagtataatataaaggtcaggagggtcacacttgcaaacatttcttctaagaggttttgtggggagtgttgttctcatccatttttaattttctggaaaaacgtatgatagatgtgtgtgtacacacacatctatacatacatagatatttgttttagtttacaagaagacacactgaataggtggatttaattcatcattggctctctgtagttgagaatcacttagatatatactttccggcatgactactatgataatatagatgtatcagtgtctaattgggataaggcccacagtcaaaagaatcctcagtctaactctctcagtctcaaaacttccaagacccaaatatcagacttacagctcaagctccacagcaataccaaccttttctagagacaagtgacttactgatcaaaatctgggctcctgttgctaatgttcctgaaacatgttgcaggagttctatctgggacctatgtgacatacatgtcatgtgccatatctcccagaacaaatatttcaggactaaatgacactaaagttgtaatcctgaattagaatcaaagtgaagcatgtcctggctgggtgcagtggctcacacctgcaatcccggcacttcgggaggtcaaggcaggaggatagcttgagcccaggagttcaagcccagcctgggcaacacggtgaaaatataagaaataagctgggcatgatggcgcgcacctgtagactcagctactgtggaggctgaggtgggaggatcgcttgagcctgggaggcggaggttgcagtgagatgacatggcaccactgcactccagcctgggcgacagagtgagaccatctcaaataaaagtaaaaataaaagtaaaaataaaaagtgaaagtggaacatgtcctgagaatcagtccaggacccatttactatggggttaggttcaaggtattaaatcttccaccatccatggactactttacaatgccaaatttttactacacctgacagccgtggaaggagagaaaccaggctgaggagcaagaattgcaagatcatgactttctgaatgcaaacctaggggactaggaaagagtttaaaataaagactaaagcactgtaattcatgagtttacttacatatctcagggctgatgtcctttccaacaaatccttcacaaattcagataaataacttgtactcatccacctttgcctgttctgccttttaaagttgaattttagtgcagttccatgtgaaatgtctatatttgtggcattcttcattttcaaatagagtaacatttgcccaggactaggagtccaagctccctttatcctcccaccccagattacatttcttatttcatggaatatctcatttgtgacactccccagtagatttttcatgttttgtaatcaatgcagaggctagtgaaaagcatgttttcagagaatctgtattacgaaaaatacttataatgttgtctggaaaaggttacaggattgtatgtgctatatgaacccaatcatgttaagcaaatgatcaaatgcaatattgtgtagaaaacagaatgagaaataaaagcaaagcattcacaaggtgtcttttagtgatagaacaatgagcaagtacattttttttatatttttaaagtttgttacaattagtatgtgtgccattcagaattaagaaactcctctcaaaaataatgtggacaccagtgttgaagagtgaagagactgggctctggaatcaattggacctgggtttaaatcccaactctctacctgtttgtagatgtgtgacctttggtccttaacttctatgagtctcaattatctcaactttaaaatgggggttataatacctacatgccaaggtttttatgagaattaagttaatgtatatgaagtggctagcactatgactgactcatagcaaccacccaataaattatggctttcattagcgattgttaatagcagtataaaatctaaaagactgtgagaaggatgcagtcttctcagagggggcagtgatggcaaaaatttggcaatacagagaggtttcttcacatcacctgttgttgcaacaatgagagaactgtgtggagaccaatctccatgcagtgggcctaccaggtaagtctaacatgtcatgaataagtgctgtctcaggtctaggtgcagagtcagggtatcatggcacctaatgtatgcccgcgtaatgtgcaacatgtggcagaagaggataaccctgtagtggtaatgatctgcgcagaagtgacattgtccccaataacacacagcagcccacatgtaggaatggggaaagggggtgatcagatcagtccttgctccgagtgtttctgagcaccaaggagaacaagagacactaagaatattagccacagtacttgacgtgtagaactgtgatgtaaagattgactaagtgaagaagttggggcagggatgtggggaaagctcactgagaaaaaaagtagagaagccaagtggctggaatgaatcttcagcaggcaatgggcaggtgtattaaaagtcccagagaaagagtaatgcaaggattggagtttctgggcctaattgagcagaattaagttgcaaatgttagcagtaatttctaatggtgcaaaaagtatgatcatgaacaatattctatctttcataaagagagactaagagagaacatatcctcactcttccacatctgaagaggttaaagttaactagttagtgctctagaacccaggaatctctgtggggttgcctaaatcacaggcagttcctggcaggcctaatcagcgatttgtcagaatgagtactatttcagcagcacccagaaatgtgctctgcagatcagtctgtcctccctcacccagtctgtcagtcagcttagccagactgacagagagaaagaaaactctgtggcctcccagtgcagtaatggccagaaagtgtttgactcatgtaaacatcatttaagatgtttacatggaattttaaagaaaaccagagaaggtcagaagaaaagcagaatgcagagactactacatctttggaaattactttggttacaatatttgtttattttaaagtaaaaacctcaaagtattgaaaatgctattgtggaagataatcacatcatatatttgtagttataaaaattgctgcgcactatcagggatcaactctgtctttctatagagagagacacgtacacactctttataaacaattgctcaagcaaaggaaaatggtctttcaaatctcaatatggttccaggaatttgttttaagtttataggggaaaatgcattatggcacatttcatcaatgtgagtgaagtcatcttctcttctcatataaggtttattaaaggcatttaatcagtgagaaagaatgaaatatttacaattctcaagtagacagtaatgatgttaaatgtgtatgatataaacatatcaaccaagtcagtggaaatttccaatttattttcaatcaaaattccttcaaaaattacaactcataagacaatattttatcagttactcatccatcttaagggaatataactttccaacggataaaatcaagaatgtaaattaatctaccctggattacgtaatatgcatgccatacaccacacaatacgccaggaaaggcaggtggcaaagtcatgctccaaaagagatccaggaacagaatcaggcatcctggtgtttttgaggtatccctactgactggctgtgcttttctctaaccttagttctttcagtaagctctcactgcacaagcatagaccctgacctgagccaacgttgtgagggaatccaagcaatgaagaaaatgaactcaattccacggaagcacgcacacacacatacacacatacctgcataggaaaaatgcccagtctttcctagaccaaagctgaggtgcattctgagcacaggtgcatattttgtggccccttctgagaacagggtcaggccaattttgtcacttattatattcctagcaccctaaactgtgcctggtagaaaacccatgttgaataaatgtttggtggatgaataaatgaatgagggaacgctgagtcttacctgtaaaaatgcaaatggtcaaagtttgctgaacacctcctctcacccagctaatcctaatcctgttcctaaaagataggtacaaaaaaaaaaaaaaaaaggcaaacccagatctgtaaagaaacaaagtcagatttaaaagggtgtttcttactgatttcccccttttgggaattcatatgtcatgttctcttagtctgagacaataaggaatactaaagaaacagaagatttctggcatccctgaacattccggcagaatatttcaagtttctagatggtccagcaaaaatttctgcaggctctaaaacagatcagcaatccattaaacgattaatcccagtcttattctaattaagtccataaaacccttctgtgttcctgccagttctgaaatctcagcaattcaactcctgtccctgccacaccctggcagtacacaggcttgtggggaagactggcacctgtataaatccactgattcagggcaaggggcaagagagtaatcaataccgaactagaagcttcacagaagatggcaagttctagggatgccccggacatttacaatcagaatcatcacggcatcaagttctctaagccatgtctatgcacactaacctttgagaagcacttaagttagaagacccagggagttcagctgggagaggttggggccttgaagtagggcagtggcagcagaggtagagccaaaataaccaacatttactgagattactacatacatactaggtcctgtgtatttcaccagtcaccatttaatccttacaacagccctgttcgataggtgctgttactcccatttcccacatgagggtactgagactcagagtttaagtagcttgtctgaagttacatagctagtacctgacagcactggaaaatcagtctgtaaacatttgcttcaccatctcctctgtagtgcttttcaactctcaaggaaggtgatctttctctctcttgctacgctacccactttctttctctcttactaaactctgaagtgattactctaaaagctctctaaactattttggaggcccaactgatgtgaaagtgagtatatgaataagtgggaaactttagaattcagtttataaccactacattctctggacaacaccacctaagcttttgtaacagccttcacattcactcttgcccaggaaagctctctagctaccctctcagatgcagtcttctacatcctgtcccctagcattttcctgggttgtacatgaagccccaaagcaatctgcttcctcttccatggtcaaactgagtgcccttcccacaaccctttcctccagaatccctaagccatgtaagaattctgctgatcagtatcaggcaggtaattaaatgtttgttaatttccctcccttatttatcaacagaatgcaacattctccttccttggttgaaacaacaaaaattcggtagaattaaatttctacatttattgtataacaatcctctgaaaggagtagaaagccaggtattcatatttacctggatattagcagagaaaatcccagttatacgacaaaatactcaagcatgaatatcatcaatctattcttgcaaatgatggttgccaagtcaattttcataacatctcttccttctctgccctggtttgggcccaactgaccagcaaccatagcctgtctgtccttggatcccatctctgtactatcactcacacttgcctgctcctaccaatcctcaatgccaggcctcaagctcaggccctttcacctcaattcctgcaaccacctcttcctccatggtctccatttttgccccctctagtccatcctcaaccagcggccaatatgatcttatacactgacttgatctgtccttccacttaaagccttcccctgggtcccccattatcccagactactggaaaggccctgcttgaagccctctgcagcaagtaatttatttgattctcagatctttttgaggtatgatctgatgttatcttcactttatagatgaaaaaactgagtcacagaaaggtagcccaagatcaaccagctagtaagtagtagatcaaagatttgaatccagagagtctggtataagaattaaaaagtacactggatttccttatatacctatgccactgtttccaagaagtcttcctggattacccctactaaaccttgccctttatgtgcatttttcttattcttccactagaatgtaagcttcctcaggacagggaaggcttattccattttctatatcctaaaacatctagaactgtgcaccacagacacaaagcattgggtatttgttcaatcaaattaaatgtatgtaagtacaaaagatgatatagaaaacttggtacaaactatgtttccttaacagctcacccttctctttgcaaagtgcagtgacagaatatggtcctatacaatgagatgacaaaatagaggaaatgagaatttagaataccaaaatcaaagagatgtggtccctaggagtcctaggattttacagaataaataattccagagaaatccagcatatttaatttccgtagtgaattctgtgtgaagtttaccaaccccatcatgtctaaggatgtttcaaagggttagagaatgggtaatggcctgtggaagcatttacaagacaaatcaattccaagtttcttgcatctagtggttaaagtgctgtctcacactatctataactgtccagggctacctccacccccaacaggcaaaggaaagttcatcatccctttgatttccagtaaaataacaagacatccttgcaggactttacttcctgaaaaaggaaaattaatctgaagtctgctactcaaatgtacacattatcacggctagttacagtagctggacaataaaacctagtgaataagacctatagatatccaggtgacaaacacgaattgtaagattttaagtggaattcaatcagcctgtagaacttaatgtttttcattattcccaaagcatgtcctaatattaaacacagaaatcaatctgtataggaagcaataaacccctgatatgaagaaaagaaaagcttctgcttttcttctggatgtattgtctggtgctatctttccctgattgatttcttcaatctgtatttcaaaggctagccttcacttcccaatgagagtggtctactgtgggattcagaggggaattccaaagttattgttaatggtccttacatttctagctatgtcacaatttccatccatttgtgaccttctgctcactaggaatgtgcctatataccaaccttgttgttctattaatccattaaattcatactcttctccaaattgacatcttataaaaatctagctgagaactgatagaactatcagtaaatttttatctcttttagatcttcttttgatttcccttagacttagcctgaattcttctaggactgggacacatgaaagcaccttaagtcaaaaagctgaagtactgcatttattcccaatacattcacaaagtgcatactccgagccagccttagcaatatcaagtgtgagaatccagagatgaagatgccacagtctctgtcctcacaaagttcacagtcaataaggagaggcattgaagtcaatcattataactccacaattagaaaggatttcatcaagattaaaacagtctgtgaaatctaaaagacaggtagaactgaaaaatattgccagttttttaattaattatgaagagtatgttactatcattcttcttccaaagcacacacacaaaaaaaactacgctgggacttgacagggaatctgtcttcaggtcccttgttataagagttccttggagatgaaaccatcctccttatgttacttttatatttaagcaataaacctcccttggaatggggctcatatgcaaccatagttagtgaatttagatttatagcagtagaaaagtataagattttagaataattaaagatagtaataacattaagtgatatttattaaacacttactacacatcccaggcattatgttccccattttacacatgaggaaaatgggttccaaatatttttgctaactttcccaaggccatcctgggagtccatggcagtgcctgagcactcacttgctgtagtgtactgccttttcattacttagcattggccctttttcaacactcttgcccatctgcaagtgtcacgtgttgtttcccaaccaccctgcttacacccacccccaatttccatctgtgaccttcagctcactaggactaagcacgaacatcccacatttctcccaattctggttcccttgcctatcaacaaattactttgatgttctgtagcaattacatttatgtccaataacttttcagcaattgatcttgctcttgaaactcacaaaaaatcataactatgctgacaaagtgtctgtaaacacatcagtgttgttcgttgaaaaaaaaataggagagagagtttggtttccatcatgttaagagctcagtcccttgacagtgattgctaagacacgggatttgaatatttgagaattcctggtctatagcaaggagtgacagtccagtgcacttcaaacctctagacagtatcaaagctgaagtgcagcagcattttaggcttcggaggaggtaagaatcttgaagtgcattccatccttgcctcatcacttccccctccagtatttgagttctaggcccctgctacatctctctcccacctagagctctcctaaagcccctttgggtgtttgttgctgtcatatctgagtggaccatgacactgaaccaaggctgatactcttagatacactcaagatccaaagacaggccaggcatggtggtacaggtctgtagtcccagctactcaggaggctgaggcaggaggatcacttgagcctgggaggtcaaggctgcagggagccatgattgtgccactcactgtactccagcctaggtgacagagtgagactttgtctcaaaaaaaagcgggggccaggtgcggtggctcaagcctgtaatcccagcactttggaaggccaaggtggtggatcacgaggtcaggagagagaccaccccggctaacacggtgaaaccccgtctctactaaaaatacaaaaaattagccgggcgtggtgacacacacctgtaatcccagctattcgggaggctgaggcaggtgaatcacgtgaacccgggaggcggaggttgcagtgagctgagatcgtgccactgcactccagcctgggcaacagagcgagactccttctcaaaaaaaaaaaaaaaaaaggaaaaagaaaaaaaaaagattcaaggacatattattgggaatattgcccctgaacacctcctagagaaattttcctgtctactcttcacacactgtaactctatcctatctatttcagctactcattgaactgagagctatgcaaaattgagttgacagagctggctgttcatggcctctctttctagggttcattagtggacactattcctgtatcctgctcttttcctctctcctttttcatcattttgtccccaagttctaatatgggttcctctccaaaagaaatcaaccagagaatttaccaaaaatgaagaatgagaaactcaaaacatgtaactgatagttcatctataagaaaagatgtatttctattaaattaaattaattaattaattttagagacagggcctttgtcactcaggctggagtgcagtggtgctatcatagctcactgcaacctcaaactccgggctcaagtgatactctacctcagactcctgagtagctaggacctacaggtgcatgccaccatgcctagctaatttttataattttgtagagataggttttactatatttcccaggctggtcctcaaacccctggcctgaggggatcctcctgcattggtctcccaaagcacagggattataggtgtgagccactgcacttggccccaagacatttttaaataaattttcatgactatttttaagctacagttctgttacttttttttttttttttttttttttttgatacagagctttactctgttgcctaggctggagtgcagtggtgcagtcttggctcgctgccacctccgcctcccaggttcaagcagttcttgtgcctcagcctcccgagtagctgggattacaggcatgtgccaccacacccagctaatttttgtattttttgtggagatggggtttcgccatgttggccaggctagtcttgaactcctgacctcaagtgatctggcagcctcgtaatttaatagaaataaaaataaacttctcatatggttcaataatttctgcagttttaataagcaggggatgtactttaaattttttactgtatagtaaacaatactttattggtaaaatactcattcaaaataagttgaaaaatgtgaaagacattaaagaataaaatttaaaaactcactaccttgatatatatgcacaaagggttatggtagccagagtttttaaccaagttaatttacttaacattataccatgaacatctttccatatcaagagagacatatatcattatgtttactgtattgtattatattattgtatttattgtattgcatgtttatattgtattattttctaaaatattttaattgagatataacaatatacaatacacatattttcagtctcatgaattctgacaagtgtaatcactatccaaaataatatatagactacttccaccaaaaaaaaaaaaaaaaaagaaaaaaagaaatgatgtaaagggagcatgttcgaaggaaaaggtcaacaggagaaaatcccatattctaatatcctggttctctttaccagatagcttttatataaaaagtagagactcgtttgtggaactaaagataacacacatcatgtaacacatctttccggaagagtcctctgtaaaaattccacttattcatttaacattaattcattttatagacattttctaagtgtggactctgtggctgactctggagaataaagagatgaagccaatttgttctgctctttggagatcagacttgtaaatagataactagaatacaaggtcaaaatttataaattccattaaaaagttatacgtaaagtgttctggaagctaagagggagaaataaaaatgaagagcacagatggaatacagaaacagaagcacagagggtcagcatctggtgttatggacagcagggaagtacctgggttaaagtaatcatactttttcttaaatgccctgaactctgctagagtgaagctcagggttccctggctaatgaaaagctcaggctgtcattcttagactcacagagaaaacagactgcactgctactgagataaagagagcaaaccattatagaagaaaaactattttcacccattatatttcaatagaatttccatttcaatccactgaggcaatccaacatgtgtaatcttgtctaacaagaaaaataatgtgaagtactaaatgacagcctccaacaacccagaatagaggctctttctttcctgcacatctcctccacacctcccatcttcactttctcccaataatttttattcaatgaataaataaatgaatgaaataatcatgttttaatattagttaaagcattggggtttgcaaatgattgcttaaaaagttaaaattgagtcaagattacattactctcatgtccatttcactatgcctctttccctaaaatgtctacagcttttaagcttcctacagttattcctttgctccttacaaaagctgaataacaacttatcctttgacttggattctacagatctgcataacagtttaaaacttctattattactcatgtaagggtaaaacttcattttatatatatttcctcacttgagtttattaaaatctatagaaactagggtttttctagtcactcaccttattaaaaaattttgcaaagttagtaacaggcttaagttaaacttgaagcctttaccggtttgtaagattaacattttatatgacattgtccacactggatctatcttatacacaatataaacagatgctgacttttcaaaattatgtattaaacagaattccaatcatatacactaaaaataaaactcactgaaatttgatgcaaagaatttctaagttttgctgaatgggaaaatcacattttactgtttccttaaagaaaagttaatttgtcaaactacaggcaaacccatttttctgcagtattttaaaggacgggttctcaggaacatggaatgggatttggtctgtgacttaagtgcccaacagatgatcctgaaaaaagaaaaaaaatcaaataatatattctaaaactcttttctttaactcttcagtgaagcaatccaccttcccagcttccttggaaggggaggagactttttgttcaccacagttgtgatgctggtgtccacactttctctccaacgaggtgaactcagttatcaaaacccaccatctcaaagccactcagaggagagggagaggggagaaatctctggcaaatgtcatccccaagcaacagcatctaagatcagaggggactgagtcaacagattcattctggatttggggagttaggcttgtttctgttgtctctgcagcagagaaagttcttaagcctgcaaggccagtttttgaatctactggagatacctcaggagtttttgatgccttcaaacctgccagagccttagtcaacacatcagagaatttggcacaaaagcattcatgaccagttgtcataagaagtttgacactgcaattagctgatggtcttcttgcccagaaatagctggtcaatattattcctggggaattcaatatagctgagccaaataccattgatcatatatataaaatggtatcatacaggtaacaacaactttcctaaaggtcactggtcctgcagaacacgaataccaaaagatgttaacaggattaagcaaaaataaaaataggtattaagtgttccttagcggagaacatttgaaaaatgctggttaaatacactgaagcagatttcttgacacaagacatctcagcacttttaatagatctaggagcacagagaatctccaaaatgacttcagtgtgtctttgtcttgttttactttctatcctcaaacacctatgcatgcattttggcttatacatgacaaaatggaaactttgaaagcctaacaaatattgaatggtctctgtgacaaaaatactagtcttaggatcccctccaaggtttatgaatggtccagggaaagatgaatgtggtaatagcagagatcctttttaactggtttactggttgcagttcaaagtgctcccataaaggtccccagcatagcctgcccaaatacctgggaaacaacttgaagaataaaggactctcagggccgggcgcagtggctcacgcctataatcacagcactttgggaggctgaggcgggcagatcacgaggtcaggagatcgagaccatcctggctaacacggtgaaaccccgtctctactaaaaatacaaaaaaaatttgctgggcgtggtggcggatgcctgtagtcccagctactcgggaggctgaggcaggagaatcacttgaacccgggaggtggaggttttggtgagtcgagatcgcaccactgcactccagcctgggcaacagagcaagacttcatctcataaataaataaataaagactctcacctaacctttcttttacaaaacaattgcaatgactgtgcattatggtatatgtctctgtcagaattatctgtgtaagataagtctccttcaggcaaacagtatgagccataaattaatatgctattaatccctgccattgaaataactttgaagacagaaacaaggtaaaatctgttcactgtatataccaccacagtagaattcctatactaaggaaatggtcccaaaatggaatttcaaggctgtgcaaggataatttgtgtttctattgagaattttttattaaatgagcaacttagcataacagaaatgtaaatctcattctctcactctctctctctctctttcaagacgaggtctcactatattgcccaggctggcttctattaataattcctcggttcaagcaatcctcccacctaagcctcccgtataactaagactacaggtgcacaaccactgcactgggctgtctcatgtaatttcaaaaaatatatttacagaattgacgagccgcatagctggaaaaatgccccatttgaaagagttgggtgagaatgagctctaattgttatatcttaagatttataaatctattttctatatctatttactttttaattacagaagtatcaaattacatttatggcaaatcatgtaaaaaaacaaattacatttatggcaataaatatatgctatgttttgatagaatacaatcatataatatctatataaacataaaattacagtagttggcgaaaattaacattaaagttcatttctgtttgcaactgttctacaactgagtacacatacacacgtgtgcacacacacacacatacacacacacacttcttattgatctacaatcaccaatttatcaaaactaagacatcttctttccttcacttgattttataattctctgagggaaattagaagagtgctacatttaaagtgatcaagtagaatctcaagataaaatatgatttgcactttaaatctgtagttgtcattggtgaaaatcaagaacatccataaacagataattttattattgatgctacacaatttcacatgtaatcaattcactaggataagagttgattttgactatttgaatgatgttacatcttggcctatgctttaagcctgactgagcattgtatgaattactaactcaggtgttattattttaaaatgcagcttattgctaggcatggtggctcacgcctacaatcccaacacttttggagggtgaggcaggaggatcgcttgagcccaggagttcaagaccagcctggagaatacagggagacactgtctctacaaaaaaatttaaaaattaggactgagcgccatggctcacatctgtaatcctagcactttgagaagccgaggggggcagatcacttgaggtcaggagttcgaaaccagcctggccaacatggtgaaaccctatcccttctaaaaatacaaaaaaaaaaaaattaggtatggtggcaggtgcctgtaatcccagctacttgggaggctgaggcaggagaatcacttgaacctgggaggtggaggttgcagtgagccaagactgtgccactgcactccagcttgggtgacagggtgagactctgtctcaaaagaataaataaataaaaataaaaataattttaaaaataaaaaataaattagctgggcatggcactacatgtctgtagtcccagctattcactggctactgaggaggctgaggtggaataattgcttgagccctggaagtcgaggctgtagtgagccatgattatgccactgcactccagcctgggtgacagagagagagagagacctcgtctcaaaaaagaaaaaaaaaattccagctcattacttagattttccccacttacaacttgatgatccgtttcaaattacagaggaatcttacttccattacaagtacatagtaaaatataaaaaggtaagtacaaaagtaaagtctgaaagacaaaaatcgttttcttacctgagaatgagagattgaaaaactgatgagtgttatgtatgggcactggatagtctatccagatcatcttagaaaaaagagatgtttttaaataaaaaatagcccatctaacaacaccagggaattcaataatcacataactgaaaataaaggtaagagaaacttttcaaccaccaagactttccagattagaaatgacttttcatagtgttacaattctcacagaaatgctattgattggagaaactgggaatgttcatcacctccccccacccccgccaaaaaaaaaatggtcttaaactgcttttagcttttgcacgaagtcaaatgtctttagtctcctcccaattccagccccctgcaatcaccatgatggtttacttgaccaaagggactgagctttctcatgctattttgtccagtggtctttgatacaagccctagagatggtgtttacatctgcctctaaggaaattctcctttttctgcaatgtaaaaactcttacttgtaatctttaccttggtttatagatacaaaagtgcgtgatggctgggagcagtggctcacacctgtaatcccaacactttgggaagcctgagacaggaggattccttgagcccaggagttcaagaccagcctaggcaacacaacgagacctcgtctctattttttaataaaaaaagaagaaaatgtaagtgttgatgttcaaaaacttcttttaacagattctatggacttgcttcactttaggcaaatagtattcttgccttttctgagggacacaccatttttgcctctggagcataccaatgccaaagccaaatagtgtagtcccaaaagagcaatctgtttctgatgtttggcaaaatatatctatccccacagcatctactgggtgtaaaggttaagtgtaacctggatgtatggacttgaatcccaaagtacatcatttttttcaagtttttccagattcaggtagaatgcactctcacaaatgttttcctcagcttccttctccctgaaccctctagaattcattgtctgctactgtctcagggcacttgtcactttctaagaggtatgatcactattcgaccccttgtctgtctcccccagtggagtatgagcacaaggccagaatgtggtctgatttctccctgtctgcagcacccagcacagggcagaagctcaagaatcatccagtgacatgaactggagccactcctcaacagatgactttcattcacatcagccaaggagcatctggcaagaacctggctaggtgcccacagttggcagttatgcccagtgcttaacttcactagtgactggcacttgggactacctgtttggcacaattgtgacctcaaggaagatcccctcacaaggtttgtcacttgaagccattgtgaagcaagcaaaagtagtcatgtggactttggaacccacttagttagacaggtttgagtttggtttggtttattaaattcatttctaccttgcctcattacagacaacatgttagtaaaggggaaatacaagaagttcaatatatgatttctccacaaatatttattgaatgtgctctcctattacaatcacatgtgttcttgtctggagattttaagcatcaccacaataaaactgtctcagcctgtcacccaaggctctctacaatacaacccaattcacctttccaatcacaacattcctgaattccaggaactacccactattatccagacactcactcttcattcatactgcccagcctttgctcatgatcatctccttgcctaaaatgtccttccctatatctttacttaatgaagtaatataaatctttcaaagcacttcccccaaagcatcttctccaataagccttttctgatcctctgtcctccatctccacagcacattgcctttacccttatggcacctgccttacttggtactgtatcaaagtcctgtattgtcagtctctccccgatcactgcagcgaatagggtaagtttctctcagcaacacaaggctatctaaacatagcctgtaaaactatgaagaataacattcagctagttgaaaattgtgaaaaatcaagaacttgttacttctccagagatcatgagatgcaggaacagaacgacctaagacatagaaaaaatgtaggaaaacatgcaggacagatgatgatatagtttgaatatctgtccttgtccaaatctcatgttgaattgtaatccccgaggttgggggtggggcctggtaggaggtgactggatcatgggggtggatccttcatggcttggtgctgtcttctccatagtgagtgagttcttgggagatttggtcatttaaaagtatgtggcaccttcccccaatcccacccccagcccccacccccaccccaaaacttcccctgccttaccccccacccccaacctctacccccagcatgcccttcccccaccccccgtcaccaccccatcttcctgcacccccttttgctctagccacatgatgtgtaagctcccgcttcactttccaccatgagtaaaagctccatccagaagccaataccatgcttcctgtaaaacctaaagaactgttagttaattaaatctcttttctttataaattacccagtctcaggcatttctttgtagcaatgcaagaacgaacttatacagatgacttaatatggagatagccattcctgttcgtataaaggtatatttcaaatgaaccatttaaaagacatcttcatgaatcatttaattaagaatttgataggtaagtttttctctgtctccagtcctttttcaatttaaaatattgacagccaatcagtaaaacaatctagagaaaatgatactggaacacttcattaaagaactttttaaacagaaagattttcatatataaatgaacagaaaaatttaaaccgtaaagaatctgaaagtattacagattatagtggaatattttaggccactcccagtccgtatttattaaggtttcctctacttgatgccgtaggaatttaccaaggaagaaagaatacagtttccaggacagcgggttctacatttctggcttctgggcaactcaagttatctacagtgatttcaaatacttttatttatttattcatcattcatgcccccaaacatactatgggcaaggcactgtgtctggtgttttcattgctattgttattattgttgttgttgtggggggtttttgtaaatcaaaaggacctaaagaaaaattaaaatattattatttcaaagaagagctatagctcttataacttacaactgtcaaaataattctctaaaaattgagcagctggaatgttaaaaggtgttaagaaaaatcaaatgagaaaatcaaagtcgtcaggtcaggctggattctctaactgaagatgttaacatttttatttactgtgtgaggtagctgggcactactcaaattttctgagaattgactcacaagatcaaactaattttaaaagaggtgatgcaaggggagctcaagcagacaggctgagaaggggttcgaggttagctgctgcagaaagaagagaaaaaggttgcaagagaggatgactcccagacatgctatgaaggaggcagactaatatgagaaggaacaaagattaagaattagatgtgttgctactgttatgggcctggggcagtggaggctaaagtagctgaaggtcaaaaggggagagtgttttttcttaaagaaaaactgaatcatggaaaagtactgaaagaaaagtcatcaactttaggttctcttgcatgcttaggcatcaatgaaacatggaagaaactccaacctctatttgacaagaattgtcaatttgaccacatagacatgagtcggacagatgacttggaagtctctttcagcttggggaatccatgactctataagacatgttcacagagaatatttgaaattagacaagtcacttgagcgccccaagggagtgacatgaggaaaagaagataagaccttggaaatattctattagatgggtggagggaaaacacagcaccaaggagagagaaaagagccaaagcaactaaggaggagatgagcacagatgggagcagcctctccactttggacaaaaacaaagcagctcaggatcagggaggaaactagaaaggaactggaaaagacagataaagacataatgttgttttgcataatgccaaaggacaacaatttcagcactccagaactctatggcacctcaatttgttccattttaataatctgttcttcccaagtaatgtcttaagtgcaagtttgccaatgttcaatttattagcagtgacatttacaaaatcgcctcaatccacttttcttcctggaaacacctaacctgggtgatcccccagccttgcacaaagcctatctgtccataaaggcttagctggcctctgtcatgagggggcctttggacaaaggagagagatttgcataaaggtggtcagcttaatacagcccctgtttgaggctgtacagcatttaaagggccattctccaacctggcagtgtaatcctaatggagagcttttgtccctaaggctgtggtgggccgctttattcagctgacaatccacagtaaaagaatgaatcaaccacctccttttagtaaagctaaggcagctggcagcccacagtcctgacagcttaccacataagaagcaggacaattatcagcctcagaccgaaaaggtgctccatgagggagtgaccacagctagggcttctggcggcatgctgggcatttaccactcaagacaaaggtcccacagcccaatctccacacaggaaaggggctgtgagagtgccagcaaagctgttccctacaatacttcccaaagagatcaaaaccctttcatcactatgtagctccttggccagttttgtggagctctacaatcattcccctttagaatgctgggaacgagccaggcttcttgtttctttttagaatttcattttttaaaaggaaatttattttaggtttcttttttaaagagtgccaaatttacaaaatagaaaggagagacaacacaagcataattctaccactctgagggaaacattgccacattagagtatttctttccagtctattttacatggctgtgaacattctgtaaatacagtttttaaatcagggcaagtctgagtagggaaacaaaccctttagcaattaggtttctaattaggtttctcctaatttattttactttatttcaactttgagaagaggaacagaatcctaacttcctttaaatcccttatcttcaagtaatccccagcctaacccccagttctcctgaatcctaccctactgttctgcctactgcagggctgccttgtcccaaaaagcagagaagttgtctcctagaagctgttgaataattttttaaaaagggctatgtccacacataaaaatctatatgcaacaaaattaatttaagatggatatataatttaagtatcaatatcacataaaaggtcaaaaaatatataccaccgagtgaaaaggttgacaatgtatgagccacattgttctcaaattagaaaaaggggccaaggaaaccttccacttcctgaaagaaaggctatggacctcctcacttaaaattatctctaatttttgctgactcttggctacctgatgccagagcccctctccccaccccaccctcagccctcactcctgtgccattccttttcgcaatgctgatggttaagacacttgcccattaacgtgaagctctgcaaatgccctggctgccagctacaatatactctctgttctatacacttcaaatgccttctctaatcacaagttagaactttacatgaaagctctaccttgtttcttatggaatgtataaaaaaatgaaagaactctcaatgagagtttccagattcttcatgttgattgactttgtgaatttcaccttaaagtacaatcattttgtgcagaaagacttttcaatttccccctcaaattcctgcctgttactttaaagctttctcatttcaaagtgctgtgtggttcatgccttacagcacagcttacacctgtatttctgaagatgattggcaaaggaggctgatatgggagacggaaaagagtaaacagccctaagtcctgtatgaagaatacccaggaatgtttcaaagtgatcttgacgcagcccaaggaggagagtgaaactgccacaatttattgtctatactaaggaatatatttattgctttctactaggaaactattaacctacaagttcattctcccaactgggagacctaaagttagaggagagcaagccaacaaaatatacttgccttaatccacactttaaaattattaatccagtgacttaagtagggggaattgcaaaatcaatggaaatcaacacccctcttgaggtcagaattcttgggatctagtcccagctctgcactagctgtgtgatcttgggcaagtcacctagcctgtctgagtacctgcaaaatggtgctaagccctggcctccctaccgcatatggccactctcaggaggatcagataccacacggatggagaagttcaccgaaaagtctaaggtgcattgctcacccatatattcggtgaaatgtctcaaatgataaggatcaccataaccttgaatgttaaggttcaccttaacaaggagacaagcttaaagaaagacacactaggagttcaacacttcttggatcctttccctaaatatcagtagtattcatgaaatcaacaaatattgcagcaagtgaaacatacatcatcaaaaaaataaaaacaaagagaaatcttggaacattgtgtgcatacatacattatggttaaatatcaatgcagaaagaagaacactattcacattcatgaatttatgctttaatttccaaagctaaatattagcttgattgaataatatcgtgtgccttgatctcaggtattagcatataaaagagctgatggcccttagctccctgccatcccaaaggtataacttgtatatttaaatatgggggacatttattagtggccatgaacactctataatcaaggaacaaccagttacctaaacaatgtgcttaactgttagaaatagaatcagaagaaaaactcatcaacgtccaaaacatcctaccctactgggacattagctagactcaagtcagaacacacacactccataaatacatatcaaataacaagaacggtattctagttctcataaacaacatttggaagtcaatttaatatttatatagtgtttggagaaagccttgccgacatcttaagcccttgataaaggacaaggggcaaatgtaaagtttcagtgtaaactgggacgtcaaaggtagtttgtattttccattaaaaaatatgacaattgttcgggcgtggtggctcacacctgtaatcccagaactttgggaggccgaggtgggcagatcacttgagctcaggagctcaagaccagcctggacaacatagcaaaaccctacaatctctacaaaaaaaacaaaaattagccgggcatagtgacatatgcctgtggtcccagctactcaggaggctgaggtgagaggatcgcttgagcccggcaggcagaggttgcagtgagccaagatcatgccactgtactacagactgggtgacagagaaagaccctgtctcaaacaaacaaaacaaaacagaacaaaaagacaattgcttagatctcgtcttttaagagactgactttcggggagtacctccttgaaaatctagtggaagcctttgtcacacagacctttgcctatcaacattcagacagagtctaagtcacatcagcatgactagagacagcagctttttatggctagagcagggtaggcattgactcatttccctgacaccagagccataaagaggtgctagtagtccccagaagcctctgccaaaaagaaaccttgatgacactgcatctttatttccagctgtgactactcctttgagctctggctctagaagcatatccagtggcttcctagatgcttcaccagcaccttatgctcaggtccaaaactaaacttacccaaatttctcctggtcccggtgctcctcatctcagtaagtggaatcagttgcataaaacaaaaacttgtaggatcactgctaacagctccctctccttcactctgcctccaaacaatccagtccagcaaatcctgatgagtccacctctaaatcaggtgtggtacgtatggcggagcatccctgactcgaaaatcgaaaatccaaaatctgaaatgctccaaaatctgaaactttattttattttatttatttatttatttatttatttatttatttatttatttatttattttgagacggagtttcactcttgttgcccaggctggaatgcagtggtgcaatttcggctcaccacaacctccacctcccaggtcaagcaattcttctgcctcagcatcccgagtagctgggattacaggcacgcaccgggcttagtagagacggggtttttccatgttggtcaggctggtctcaaactcccgacctcaggtgatccacctgcctcagcctcccaaagtgctgggattacaggcatgagccaccgcgtccggacaaaatctgaaactttttaagtgtaaatatgacactcaaaggaaatgctcactgaaacatttttggacttcagattttcaaattagggatgctcgcccagtaagcataatgcaaattacatgtattccaaaatctgaaatctgatacacttttggtcccaagcattttggataaagggtatcaacctgtacagggaatcactttcttaaaatcctgccgtggctccctaatgtccaagaaatgaaaggcaactcctcaaactgatccctcctctttcaaaggtcacaaggatagccaccctcacctggtcacctcctgcttcggaaaatgctaggcatttttgctcctccatcattttgttagtatgtgtgtctccctctgccttctccttccagagttattaatctcataacttaaaacccaatctaaatcctcctctttggggaagatgggctgaggccctaacccagggtaaattgatcactcccttctctttgaagtccagtgtctgggtttcttattcacatattatagctcaaagcaaataatgggatataataatttgtttgcacgtttctctgctccactagcctatggactccctaaaagctgcatctttattctcagttgctttgccctgtatcttagctcaaaacgtgcctctaacagaacttctgaatatgtgttgaatgaaatgttgaaaccaaaaccaggagagttaaactacacttttatcacaaattttcgttttactaccaacaaccaaatgctctccccataatcctaattaccttatcaaccctatcaactttcagttaagagtaggaggatttctagtctaattcttattacccaagaaactgggtatctgtgaattactttgcaaagaaatctgcccataaaggccagccattagaaagccacttctggctgggcgcggtggctcatgcctgcaatcccagcactttgggaggcgaaggcgggcggatcaccaggtcaggagatcgagaccatcctggctaacatggtgaaaccccgtctctactaaaaatacaaaaaaattagccgggcatggtagcgggcgcctatagtcccagctacttggcaggctgaggcaggagaatggcgtgaacctggcaggtggagcttgcagtgagccgagatcacgccactgcactccagcctggttgagagcgagactccgtctcaaaaaaaaaaaaaaaaaaagtaaggaaaaagaaaaaagaaagccacttcccactggctcctgacttgctgggaaaagaaaaggaggaacagccctcacgcctgttctttgctgatggaagaaaggtccagttcccgcccccacatcctccctccatcactgccaactctcctaaggaagtgctaggctaatctcaaagacagatgtctctctaagtaagtactgacagattggagggcatctactggctacattggcctgaatactttcaaagtcatgagtccaatgctttctgcccattctctttagtttggtggaaaggattttcttttgctgcctgagtgtctttacccctcagtactctctgttctagaactggcagagaaataagcacaacaaatctactttagatacagcttaacttactgaaagaactaaggttagagaaaagcacagccagtcagtagggatacctcaaaaaaaccaggatgcctgattctgttcctggatctcttttggagcatgactttgccacctgcctttcctggcatattgtgtggtgtatggcatgcatattacataatccagggtagattaatttacattcttgattttatacattggaaagttatgttcccttaagatggatgagtaactgataaattattgtcttatgagttgtaatttttgaaggaagttttgattgaaaatacagggtcttgctctgttgttcaggctggggtgccgtggttcattcatgactcactgcaacctcgaactcccaggctcaagcgatccctcccacctcagcctcctgactagttgggcaccacacgcccagctaattttttttttttttttaatttttgtagagaacaggtctcgctaagtccgccctagctggtctcaaactcagccgtaaccagtagctgagactaagatgcctgccaccgcaccgacgttcgcctccattatcggtcttcagatacatggctgctggcactttcacgctaatctgactccattttgaaaaaacacattttctaaggtagccacaacttctgtgctctccgtgtaagtgtgcccaaatacacatcctgacataaactcctcatcatttgaaatccaaaaaagcaaaaaacaaacccaaaggacaacaaaaacttcaagcagatcctttgaaaagccgctactgccctgaaaattctgaagtctgagatttcacgtgtacaaactgctcaatctgctgaaaaccaggcaaacctctcgatatacgcgcccaccccagcacaccgtccccgactgtggtaatggagacgcgccccagacctgccggacagagcctggcgttctcacccgaaccgcccgctcagaccggcctattcgcgacaccgcaagctttccattcttcccaactctgcttcaatttctcgaaatgtccaaagaaaaatcaatgggtgcctcctatggtgcacctacgatggtgcccaatgcaggaggaggttcagaatgtgggggtcttcctcgtgtaacccccagctacccgctgccacccctctccttctgcctcatcccaaccaaccttcccaggatgaccaggaaaacgagggtcctgcagggaatgtctctgatggagtagcttgggctcctcagccaccgagggacaaaggggctggctccccgccgccaccccaaggcattttactttgcagtagctttcattaacggacttcactcacccttgtggaactcttcactgctggaggccgcagggacttggggtaccttgaagctcctccctgtggtctccggtgagagcccgggagcctggtgggcgcccggaaagtctggaaatgaggagcagcttctagactcttcagggaagtgcgtgggccccagagtgcaaagcgcgtggtgggggcgtggcagagaggggaggcaggcatggaggcagcgtggcagcggaagtaggggggaggagtggtagcatttttccctagacctcgcgatgttggggcccgagataactactgtctctggaactaggagtgcagataagccacttcaacgtagcccttagcttgtcgagtcaaagggttccaccccaatacaggctctccaccctccctggacccctgagcactacctaagcaggacctaatggagcccagaaaatgtatggatcccagaaaagaggggtctttttgagtccaatcatggctctattgtggaactgagaggtgacagcgagctggcaaccctcgcagccgtccctcgcactccgcacctcctcggccttggcgcccactctggccgcgcttgaggagcccttcagcccaccgctgcactgtgggagcccctttctgggctggccaaggccagagccggttccctcagcttgtgggaaggtgtggagggagaggcaccggtggcaactggggctgcgtgcggcgcttgcgggccagcgcaagttccgggtggacgtgggctcagcgggcctgcactcggagtggcccggtgggcccgcaaggcccgggcagtgaagggcttagcacctgggccagcagctgctgtgctccatttcttgccaggccttagctgcctccctgtggggcagggcttgggacctgcagaccgccatgcccgagcctccaccccccccgcccccccccgaccaccgacaccccccgcccccccgccccccccgccccccgcccccccgacccccgaccccccgccccccgcccccccaccccccgccccccccgctgccccctcaccccagccccactccccgcccccccgcctgctccccctgccccggccgtcggctcctgtgcgcaggagccttgcggaggagtgccgcttcctgctccagggtgcccagtcccatcgactgcccaagggctgaggagtgcaggcgcactgggcggaactggcaggcagctccacctgcggccccctgtgggatccactgggtgaagccagctgggctcctgagtctggtggggacttggagaatctttatgtctagctaagggattgtaaatacaccaatcagcactctgtatctagctcaaggtttgtgaacacaccaatcagcaccctgtgtctagctcaggatttgtgaatgcaccaatcggcactctgtatctagttaatctggtggggacttggagaacctttatgtctagctgagattgtaaatgcaccaatccgtactctgtatctagctcaaggtttgtaaataccccaatcagcactctgtgtctagctcagggattgtaaacgcaccaatcagcaccctgtcaaaatggaccaatcggctctctgtaaaatggaccaatcagtaggatgtgagtggggccagataagggaataaaagcaggctgcctgagccagcagtggcaatccgcccgggtccccttccacactgtggaagctttgttctttctctctttgcaataaagcttgctgctgctcactctttgggtccacactgcctttatgagctgtaacactcaccacgaaggtctgcagcttcactcctgaagccagtgagaccacaaacccaccaggaggaacaaactccagacgcactgccttaagagctgtaacactcaccgtggaggtctgcagcttcactcctgagccagcaagaccacgaacccaccagaaggaagaaactccgaacacatctgaacatcagaaggaacaaactccggacacgccgcctttaagaaatataacactcaccataagggtctgcggcttcattcttgaagtcagtgagaccaagaacccaccaattctggacacattttggtgaccacgaagggaccatcgcctatcgccaagcagtgagactatcgccaagtggtgagaccatcgcctatcactgagcggagagattatcgcctatcgccaagcagtgagtaccatcggacccctttcgcttgctattctgtcctatttttccttagaattcggaggctaaataccgggcgcctgtcggccagttaaaagcgactagcgcggccaccggactacagacacaggtgtcaggctttctgggaaagggctctctaacaacccccgactcttcggagttaggagcgttggtttgcctagaaccagcttccacttttcctgtacttctgggctgagccgagggtcgacagagaggaaacccatgcagctccagggtcccaacgacaagttggttgaccctgcggccatgagcggaactctcaaaggcatgttgcccaagcgagactcgcccatctatcctatctatcctgacctttgccccctgggtcctaatgcctgccagacaaacttcctctcgcctctcttctccgaggttagtcccgcttctaaaaattgttacctgtctctggtgcttttctagtttctcctataagtatgatttctagtataaactccaggactgttaccttctttaggaacccaggctcaccaatcagaaagacataacttttgcccaaagccccgtcatagtggggactacctggaattttatgatccctcctctcctcagactaataggcctaacaaaagctattcctgaagctaggatatggggagcctcagaaattgtatccttcccgttcatataagtgaggacaaaaggtgtcactcttccaaccgtggagatcccttccctccctcagggcatggccctccacttcatttttggggcataacacctttataggacaggggtaaaatcccagtactaacaggagaatgcttaggactctaacagattttcgagaatgcatcggtaagggccactaaatctgatttttcttcgtcggtcctccttgtggtctaggaggacaggcaagggtgcaggttttcgagaatgcgtcagtgagggccactaaatccgaccttcttcggtcctccatgtggtctgggaggaaaactagtgtttctgctgctgcatcagtgagcacaactattccgatcagcagggtccagggaacgttgcaggttcttgggcagggggagaaacaaaccaaaactgcgggcggttttgtctttcagatgggaaacactcaggcatcaacaggctcacccttgaaatgcatcctaagccattgggaccaatttgacccacaaaccctgaaaaagaggtggctcatttttttctgcactacgccttggccccaatattctctctctgatggggaaaaatggccacctgagagaagtacaaattacaatactatcctgcagcttgaccttttctgtaagagggaaggcaaatggagtgaaataccttatgtccaagctttcttttcattgagggagaatacacaaccatgcaaagcttacaatttacatcccacaggaggacctctcagcttacccccatatcctagcctccctatagctccccttcctattaatgataagcctcctctaatctcccctgcccagaaggaaacaagcaaagaaatctccaaaggaccacaaaaacccccggactatcggttatgtccccttcaagctgttagggggaggggaatttggcccaacccaggtacatgtccccttctccctctctgatttaaagcagatcaaggcagacctcggggagttttcagatgatcctgataggtacacagatgtcctacagggtctagggcaaaccttcgacctcgcttggagagatgtcatgctactgttagatcaaaccctggcctttaatgaaaagaatgtggctttaggtgcagcctgagagtttggagatacctggtatcttagtcaagtaaataatagaatgacagctgaagaaagggacaaattccctaccggtcagcaagccatccccagtatggatccgcactgggaccttgactcagatcatggggactggagtcataaacatctgttgacccgtattctagaaggactaaggagaattagaagcccatgaattattcaatgatgtccaccataactcagggaaaggaagaaaatccttcttccttcctcgagtggctacgagaggccttaagaaaatatactcccctgtcacccaaatcactcgagggtcaattgattctaaaagataagtttactactgaatcagctgcagatatcaggagaaagctccaaaagcaagccctgggccctgaacagaatctagaggcattattaaacctgccaacctcggtgttctataacagggatcaagaggaacaggcccaaaaggaaaagtgagatcagagaaaggctgcagccttagtcgtggccctcacacaatcaaaccttggtggttcagagaggacagaaaatggagcaggccaatcacctggtagggcttgttatcagtgtggtttactaggacacttcaaaaaagattgtccagtgagaaacaagctgccccctcatccatgtccactatgcagaggcaatcactggaaggtgcactgccccagaggatgaagattccctgggtcagaagcccccagccagatgatccaacaacaggactgagggtgcccagggcaagcaccagctcatgtcatcaccctcactaagccccaggtatgtttaactattgagggccaggaaattgacttcctcctggacactggcatggccttctcagtgttaatctcctatcctggatgactgtcctcaaggtccgttaccatccaaggaatcctgggacagcctgtaaccaggtatttctcccacctcctcagttgtaattgggagactttgctcttctcacatgcctttcttgttatgcctgaaagtcccacacccttattagggagggatatattagccaaggctggagctattatctacatgaatatggggaacaagttacccatttgttgtcccctacttgaggagggaatcaaccctgaagtctgggcattggaaggacaatttggaagggcaaaaaatgcccacccagtccaaatcaggctaaaagaccccaccacttttccttatcaaagacaatattccttaaggcctgaagctaataaaggattacagaatattgttaaacatttgaaagctcaaggcttagtaaggaaatgcagcagtccctacaacaccccaattctaggagtgcaaaaaccgaatggtcagtggagactagtgcaagatcttagactcatcaatgaggcagtaattcctctatatccagttgtacccaatccctataccctgctctctcaaataccagaggaagcagaatggttcacggctctggacctcaaggatgccttcttctgtattcccctgcactctgactcccagttcctctttgcctttgaggatcccacagaccacacgtcccaacttatgtggacggtcttgccccaagggtttagggatagccctcatctgtttggtcaggcactggcccaagatctaggccacttcttaagtccaggcactgaggtccttcaatatgtggatttacttttggctaccagttcagaagcctcatgccagcaggctactctagctctcttgaactttctagctaatcaagggtacaaggtgtctaggccgaaggcccagctttgcctacagcaggtcaaatatctaggcctaatcttagccagagggaccagggccctcagtaaggaatgaatacagcctatactggcttaccctcaccctaagacattaaaacagttgcaggggttccttggaattaccagcttttgccgactatggatccccggatacagtgaggtagacaggcccctctatactctaatcatggaaatacagaaggcaaatactcatctagtagaatgggaaccagaggcagaaacggccttcaaaacctcaaagcaggccgtagtacaagctccagctttaagccttcccacaggacaaaacttctctttatacatcacagagagagccgggatagctcttggagtccttactcagacttgtgggacaaccccacaaccagtggcatacctaagtaaggaaattgatgtagtagcaaaaggctggcctcactgtttaagggtagttgcagcagtggccatcttagtgtcagacgctatcaaaataatacaaggaaaggatctcactgtctggactactcataatgtaaatggtatactaggtgccaaaggaagtttatggctatcagacaaccgcttacttagataacaggcaccactccttgagggactggtgcttcaaacacgcacgtgtgtggccctcaaccctgccacttttctcccagaggatgggaaaccaattgagcatgattgccaacaaattatagtccagacttatgccgcccaagatgatctcttagaagtccccttaactaatcctgaccttaacctatataccgacagaagttcatttgtggagaatgggatacgaagggcaggttacgccatagttagtgatgtaaccatacttgaaagtaagcctcttcccccagggaccagtgcccagttagcagaactaatggcacttatctgagccttagaactgggaaagggaaaaagaataaatgtgtatacagatagcaagtatgcttatctaatcctgcatgcccatgctgcaatatggaaagagagggagttcctaacctctgggggaacccccattaaataccacaaggaaattataaagttattgcatgcaatgcaaaaacacaaggaggtggcactcttacactgccaaagccatcaaaatgggaagaagaggggagaacagcagcataagtggctggcacaggtagggaaagaccagcaagaagaaaagagagaaaaagaaagtcagagaaagagagagagtgaggaagaaacagagagacaaagagaaggagtcagagacaaagagggacagacacagaaagtcaaagagagagttaaaaagagaggaagagacaaagaagaagtcaaagagagagagagaaagaaatagtaaagaaaaaaacagtgtaccctactcctttaaaagccagggtaaagttctgtctacccagccaaggcatgttctttgtatgtggaacatcgacctatatctgcctccccactaactggacaggcacctgcaccttagtctttctaagtcccaacattaacattgccccaggaaatcagactctatcagtacgcctcaaagctcaagtctgtcagcacagagccataaaactaatacccctacttatagggttaggaatggctactgctacaggaaccagaacagccagtttatctacttcattatcctactaccacacactctcaaaggatttctcagacagtttgcaagaaataatgaaatctactcttactttacaatcccaaatagactctttggcagcagtgactctccaaaaccgctgaggcctagacctcttcactgctgagaaaggaggactctgcaccttcttaggggaagagtgttgtttttacactaaccagtcagggatagtatgagatgccgcccggcatttacaggaaaaggcttctgaaatcagacaatgcctttcaaattcttataccaacctctggagctgggcaacatggcttctcccctttctaggtcccttggcagccatcttgctgttactcacctttgggccctgtatttttaaccttcttgtcaaatttgtttcctctagaatcgaggccatcaagctacagatggtcttacaaatggaaccccaaatgagttcaactaacaacttctactgaggacccctggaccgactgacctgctggcacttcccctggcctagagagttcccctctggaggctagagcggtcatcggccaaattcccaacagcagttagggtgtcctgtttagaggggggattgagaggtgacagcgtgctggcagccctcacagcccttgctcactctcggtgcctccttggcctcggcgcccattctggccgcacttgaggagcccttcagcccgccgctgcactgtgggagcccttctctgggctggccgaggccggagccggctcccttggcttgcggggagatgtggagggagaggcgcgggcgggaactggggctgcacgtggtgcttgcaggccagcacgagttccgggtgggtgtgggctcggcaggccctgcactcggagcggccggctggcccacaagcgctaggcagtgaggagcttagcacctgggccagcagctgttatgctcgatttctcgccgggccttagctgcctccccgcagggcagggctcaggtcctgcagcccaccatgcctgagcctccccacaaccctgccatgggctcctgcatagcccgagcctccccgacgagcactgctccctgctccacggtgcccagtcccatcgaccacccaagggctgaggagtgcaggggcacggcgcaggactggcaggcagctccacctgcagccccggtgcaggatccactgggtgaagccagctgggctcctgagtctggtggggacttggagaacccttgtgtctagctaagggattgtgaatgcaccaatcggcactctgtatctagctcaaggtttgtaaatgcaccaatcagcactctgtgtctagctcaaggtttgcaaatacaccaatcgacactctgtatctagctaatctagtggggacgtggagaacttttgtgtctagctcagggattgtaaacgcaccaatcagcaccctgtcaaaacagaccaatcagctctctataaaacagaccaatcggctctctgtaaaatggaccaatcagcagggtgtgggtgggcccagataagagaataaaagcaggctgcccgagccagcagtggcaacccgctcaggtccccttccacactgtggaagctttgttcttttgctctttgcaataaatcttgctactgctcactctttgggtccacgccgcctttatgagctgtaacactcaccacgaaggtctgcagcttcactgctgaagccagcaagaccacgaacccaccagaaggaagaaactccgaacacatctgaacgtcagaaggaacaactcgggaggaacgaacaattccagacgcaacgccttaagagctgtaacactcaccgcgagggtccgcagcttcattcttgaagtcagtgggaccaagaacccaccaattccggacacagaactaaagaaggtaggaccacatcctgatctaaagggcctttgcagcctgacagagcaaaatgcgacccttgttgagtatcaagtccagcttagcagggcatcagtgggtgtctggaaccccagaggtcagagggagggcaacaactgcacagtgttccccttgacctgctgcctcatttagtatggtggtctcaatcacaaggccagcctttttttcacacctcccaatctgccttcctctctggccttttccaggagacatacccactgagctttgcagggttgccctatattacaccatttgatttctccagtctgtttctaaacactcacggggaagatgatctcacaacctccctcaccactcattccagagtggaataaatcctcaatgaggaatagatttaacactacatgttattttcttaaactgaccaattttgagacaagttaaaaagacattcagatattaaaagatcaaaaaccaactttaattctgctctatcactaagcacaggaaaaacaaagcaaatattaatttaacatcattaatattaaactgtattcataatagtgataacccctgcccctctgacaaggaggatatgtcacagaaagggccctagagcattcaacctcctactcaatccttgtaacgtcaaaagttgaccactctgaaaggtggtctttggatgtattattttctccatatcaaaattgaagatcaatgaacttcagaaacaagctcctaaacccagtttcagaagggactcatttaaaaacagcatgggtcttcctgacggcattttaaataaaacattctgactcgcagctgtgtctgcaaccttcgggcactacaaacaaactctaattattaagtttaaaagcttcagcatgacatgacatctgaaataaccaggaaatgatagagcaaaaagttgtttagcgaggcagccatttatgtaatacttctagtaacctaaatcacaatgctctgctaggggcagagaaatcaggtctcttcttccccaacacacatgcaattcttgtccttaagcaaatcacttcccttctttaagtgccgtattacatgcaaaggggtgataacaacatgtatgtatgtaatacttgtcatttgtagagtatattgtctgcataaattaattttaattgtaaatttagtagtgagttgtcagaaacaacgttcaaaaaggatttttacatgcttttctcctgataacatctcaaccaagcttcctcagaaaggagttatgactcctgccacaaaagcagagagattagcggcagcaaagaacaggaagagtttgggcttaagtataaatcctggccagtcttagagaacgtaattaatatctctgaagtcatggtgtccttctcctgacaatgggcccagtaataaatagtacttgcctcacaaaattgggatgattcagtgggatgatgcatgcaaagcacttagcaaagggcctggcagggaggtggtcctggccagtgaggctgtaattaccagcggaaaccacaatagaatactcaccaaaggcaggaagggcttccagatgtccatcccacctgaacatgggatgcaggatttggggcacttcgacctgagactctagtggtctttcttggaagtatcatcttacctctgctctttctcacagggggactggtcaatatcaaagactaggcacttgtctgcaaagaaaagacagttgtgagtagcctgtacagcaagtcctgaaatttcatagaaatctctggaggaattccttggaagacataaagccaagtgaggtaacgttttatttctatgtggtcatcaaactgccatttgtttggttcatcctcaaaggaggtaagtatctcattttcacatctctcgaggcaaacagagcaaacttgcacaaaatcaacatgaagtccctcttggcttataagaatactcacacttttgttcatatccagtttatttgaatgcaattttgtgaagccttggtaatatttccattacatctgaaatacactgatcaatgtgtgatttgagttttcctcaaaagtcctccatttttctggggggggagtatgatgttaatacatagtggtgtcccttaaagacatctgctgtattttacttgttgaaaaacttaatgataaatacatgaaaggaatttaagtagtgctattttaattcatttggaatttttaaaaaatcaaccaatgaattctagaaggatcctcattttatgtctatacagttttcagctctattcatcaaacatacagtgggtgacttctatttcattacctactacagtcttcataattccaagagtacaaactggatataagatccatttctagatgtcaagcctctcctatatagcatgattattgctctctgacagaaatctcaaaaacagtcatgctttctggtgctaaaaatgttctttaggcacaagaaatgccatataaactgtcctctcccccatcactggcactgttttagttcacatcgccatcaactctagtctgcactcctgactggagttcttgctgcttccaatcttgacccctccaaattgttctccaccgagcagccattgtgacctctaaaacgaagttcatgtcacatcacttccataatggtgagaggtgacagcgtgctggcagtcctcagagccctcgcttgctctcggcacttcccctgcctgggctcccactttggtggcatttgaggagcccttcagcccccccccccgtgcactgtgggagcccccttctgggctggccaaggctggagcccactccctcagcttgcagggaggtgtggagggagaggcgcgagcgggaaccggggctgcgtgcggcgcttgcgggccagctggagttccgggtgggcatgggcttggtgggccccgcactcagagcagccggccagccctgctggccccgggcaatgagggacttagcacccgggccagtggctgtggagggtgtactgggtcccccagcagtgccggcccaccggcgctgtgctcgatgtctcgccgggccttagctgccttccagtggggcagggctcgggacctgcagcctgccatgcctgagcctcccaacccattccatgggctcctgtgtggcccgagcctccccaacgagcaccaccccctgctccacggcgcccagtcccatccaccccccaagggctgaggaatgcaagcacacggtgcaggactggcaggcagctccacctgcagccccggtgcaggatccactaggtgaagccagctgggctcctgagtttggtggggacgtggagagtctttatatctagctcagggattgtaaatacaccaatcagcaccctgtgtttagctcaaggtttgtgagtgcaccaatcgacactctgtatctagctgctctggtgaggacgtggagagtctttatatctagctcacggattgtaaatacaacaatcagcaccctgtgtttagctcaaggtttgtgagtgcaccagtcaacactctgtatctagctgctctggtgaggacgtggagaacctttatgtctagctcaaggattgtaaatacaccaatcggcactctgtatctagctcaaggtttgtaaacgcaccaatcagcgccctgacaaaataggccactcggctctaccaatcagcaggatgtgggtggggccagataagagaataaaagcaggctgcctgagccagcattggcaacctgctcgggtccccttccacactgtggaagctttgttctttcgctcttggcaataaatcttactactgctcactctttgggtccacgctgcttttatgagctgtaacactcaccgcgaaggtctgcagcttcactcctgagccagcgagaccacgaacccaccagaaggaagaaactccgaacacatctgaacatcagaagggacagactccagacgcgccaccttaagagctgtaacactcaccgcgagggtccacggcttcattcttgaagtcagtgagaccaagaacccaccaattccggacacaatgggaatactgtcagctcccctactgccaccaccaccatttttgcttgttgagaaaggcccagtgccagcctcacctcctctaatacccctcccaattataatgacagcttttctctcctcactccacaacaggtaaatatatataactttgctagagtttttattgttttgatttttatttcttaaatattatcattaggcttgaacatctttttatagagtaatagatcatttatttcatttattttttcttggtgaattgccaattaatttccctttttttcttttactttaagttctgggatacatgtgcagaacgtgcaggtttgttacgttggtatacatgtgccatggtggtttgctgcacctatcaacccgtcatctaggttttaagccccacatgcattaagtatttgtcctaatgctctccctctccttgccccccaccccccaacaggccccggtgtgtgatgtctttcaccttgtgtccatgtgttctcattgttcaactcccacttatgagtgagaacatgtagtggctctttttttgttgtgtctctgacaggttttggtatcaggatgatgctggcctcataaaacgagttagggaggagtccctctttttctattgcttggaatagtttcaaaatgaatgctaccagctcctctttgtacctctggtagaattcggctgtgaatccatctggtcctgggctgtttttggttggtagggtattaattactgcctcaattatagaacttgttattggtctattcagggattcgacttcttcctggtttaatcttgggagggtgtatttgtccaggaatttatccatttctcctaaattttctagtttatttgcatatagatgtttatagtattctctgatggtagtttgtatttttgtggtatcagtggtgatatcccctttatcattttttattatgtctatttgattcttctctcttttcttctttattagtctggctagtggtctatctattctgttaatcttttcaaaaaaccagcttctggattcattgattttttgaagggttttttgtgtctttatctccttcagttctgctgtgatcttagttatttcttgtcttctgctagcttttgaatttgtttgctcttacttctctagttcttttaattgtgatgttagggtgtcgatttcagatctttccagctttctgatgcaggcatttagtgctttaagtttccctcttaccactgctttagctgtgtcccagagaatctgatacattgtctctttgttcttgtcggtttcaaggaacttctttatttctgcgttaatttcgttatttacccaggagtcattcaggagcaggttgttcaatttccatgtagttgtgcggttttgagtgagtttcttaatcctgagttctaatttcattgcactgctctctgagagactgttatgatttcaggtcttttgcatttgctgaaaggtgttttacttccaattatgtggtcgattttaaagtaagtgctatgcggtgctgataagaatgtatattctgttgatctggggtggagagttctgtagatgtctattaggtccacttggtccagagctgagttcaagtcctgaatatccttgttaattttctgtctcattgatctgtctaatattgacagtggggtgttaaaggctcccaatattattgtgtgtgagtctaagtctctttgtaggtctctaagaacttttttttatgaatctgggtgctcctgtattgggtgcatatatatttaggatagttagctcttcttgttgcattgattcctttacaattatgtaatgcccttctttgtctcttttgatctttgttggtttaaagtctgtttcatcagagactaggattgcaatccctgctttttttgctttccatttgcttggtaaatattcctccatccctttattttgagcctatgtgagtgtttgcatatgatatgggtctcctgaacaccacacgcggatgggtcttgactctgtatcctatttgccagtcagtgtcttttaattggggcacttagcccatttacatttaaggttaatattgttaggtgtgaattggatcctgtcatcatgatgctagctggttattttgcgcattagttgatgcaggttcttcatagtatcattgttctttatattttggtgtgtttttgcagtggctggtaccactttttctttccatatttagtgcctccttcaagagctcttataagacaggcctggtggtgacaaaatcccttggcatttgcttgtctgtaaaggattttatttctccttagcttatgaagcttagtttggctggatgtgaaattctgggttgaaaattcttttctttaagaatgttgaatattggcccctactctcttctggcttgtagggtttctgcatagagatccgctattagtctgatgggcttccctttgtaggtgacctgacctttctctctcgcagcccttaacattttttccttcatttcaaccttggagaatctgacaattatgtgtcttggggttgctcttctagaggagtatcttagtggtgttctctgtatttcctgaatttgagtgctggcctgtcttgctaggttggggaagttctcctggataatatcctgaagagtgttttcctacttgattccattccccccatcactttcaggtacaccaatcaatcataggtttggtcttttcacataatcccaagaaatttcacatatttctcggagtctttgttcattccttttcattcttttttctctaatcttgtcttcatgccttatttcagtaaggtgatcttcaatctctgatatcctttcttccacgtgatcaattcagctactgatacttgtgtatgcttccacgtgatcaattcagctattgatacttgtgaagttctcgtgctgtgtttttcagctccatcagctcatttatattcttttctaaactggttattctgcttagcagttcctgtaaccttttatcaaggttcttagcttccttgcattggattagaacatgctccttcagttcagaggagtttgttattacccaccttctcaagcctgcttctgtcaattcatcaatctcattttccatctagttttgtgcccttgctggagaggagttgtgatcatttggagaagaggtattctggtttttggaattttcagcctttttgtgctggtttttcctcatcttcatggatttatctacctttggtctttgaggctgatggcctttggaaggggtttttgtgtgggggtcttttttgttgatgttgatgttgttgctttctgtttgttagtttttcttctaacagtcaggcccctcttctgcaggtctgttgcggtttgctggaggtccactccacaccctgtgcacttaggtgtcaccagtggaggctgcagaacagcaaagattgctgcctgctccttcctctggaagcttcgtcctagaggggcgctggcctgatgccaggcggagctctcctgtatgaggtgtctgtcgatccctgttgggaggtttctcccagtcaggaggcacgggaatcagggacccactcaaggaggcagtctgtcccctagcagagttggtgcgctgtgctgggagaatcccccttgtcaggatcagatgctctctccagagcttgcaggcaagaaagattaagtcctctgaagctgcgcccacagctgcccctcaccctaggtgctctgtcccagggagatgagagttttatctggaagcccctgactggggctactgcctttccttcagagatgcccttcccagtgaggcggaatctagagaagcagtctggccatagccggtttgctacacagtggcgaattcctcccagtccaaacctcccagtcttcttaccactgtctggggaaaaccgcctactaaagcctcagtaatggcagatgcccctccccccaccaagctccatcctcctaagttgcctccagactgctgtgctgacagtgagaatttcaagccagtggttcttagcttgctgggctccgtgggagtgggacccactgagcaagaccacttggctccctggcttaagccccctttccaggggagtgaactgttttgtctcactggtgttccaggtgccactgggatatgaaaaaactcttgcagctagctcggtgtcggcccaaacagccacctagttttgtgctagaaatccacggtcctggtagttagacacacgagggtatctcctgatctgcagattgcaaaaaccacgggaaaaacatagtacccaggccaggtagcacagtccctcacggcttcccttggctggcggggtggggaggtcccccagctccttgcacttctcgtgtgaagcaacgccccactctgcttctgcttgctctccttgagttgtacccactgcctaaccagtcccaatcagatgaactgggtacctcagttggaagtgcagaaatcatctgccttctgcgttggtcttgctgggagctgcagaccagagctgtttctatttggctatcttgtctttactcctagagttcttactaaatgttttgatgtgacaaactatggaagaaacatgttttggcattggaatccaggaaaaaaaataatgcctttcagaaacagcattaactaaaaagaaaaaaaaaatgttaaaacatgttcttagagagcctaaacctctatgatttcttcttcctctgctctcaatttaacaagaacaagtttaggccaggcgaggtggctcatgcctgtaatcccagcactttgggaggccaaggtgactggattacttgaggtcaggagagtgcgagaccagcctggtcaatatggtgaaaccccgtctttacaaaaatacaaaaattagccagatgtggtggtgtgtgcctgtaatcccagctgctcagggaggctgaggcaggagaatggcttgaacccaggaggcagaggttgcagtgagctgagatcatgccactacactccagcctgagtgacagaacaagactccgtcaaaaaaaaaaaaaaaatcaagaccactgaaagtacctatgtcctctaacctacagagtgttggtgaacctcagaagagtctctcacaaagatgacagaagggcaaaagtcggaaatttgcttggagtcttgccttagtgatcctagcatagccaagctggccattatggatggtctagtccaagcccttcactttctaattgaggacagtgaagcccagggagttctttggggagaattatcaaatcccagggctagagattagttgtacccagatgagaagccctggatgctcccactttatcatgcccacgtgtattttgctcccacaaaatggttgctttgaaacagagcatgaacaggctctaaagttgttcctaaatttccaacaaatggtaagatggtagacttaaacccaggcatatcaataattagattaaaagaaaataatagtatgaaaacctcaatcaaaagacaaaaattaccagactgggaaaataaagcaatctgaacaataatctcatatataggaaacacctctgtttttgagacagggtctcctttagtcacccaggctggagtacagaggtgcagtcacagctcactgccaccttgaccttctgggatcaagcaattgtcccacctcagcctccagagtagctggaactacaggtgtgctccaccacacccagatacttttttgatttttttgtagagacggggtctcacttcgttgtccaggcgtcttgaactcctggacttaagcaattctcccatctctgcctctgaaactgctgggattataggtgtgagccatcatatccagcctataggaaatgcctttaaatacaaagatgaagagaggttaaaagtaggatgaaaaacaggtatcatgcaaatattaattataaaaaagatggagtagctatattaatattagataaaatggactgcaggataagtaatcttaccaggaataagaataacttttcatagtaataaaagagtcaattcaagaaggcataacagcatcaaaaagaataaaatgcttaggaataaactttttttttttttcgagatggagtctcgctctgttgcccaggctggagtgcagtcgcgtgatcttggctcactacaacttctgcctcctgggttcaagggattctcctgcctcagcctccggagtagctgggactacaggtgcctgcagccacgcccagctaatttttttgtattttatctgccaaatgtctaggcagataaaaaggggtccctggagaatctccaaactgccccacaagtttttacatcagatgcttgtgtgcaggtgaagaaatctgcccaggacttgtctgggcatgcccacagtggactggagctcaacatatgcactgggggaagtgggtggagccacagggaattcacatcttaagcagaggaggactctgctctcttcagcttgtgtggtgacctgggaatctatctgtgtggtggagggcctgttagcaaggaggttaaagatttgtgcactaaaaagtacaaaatgctaaaataaatgcaagaagacacaaaaaacggaaaggcatccccatgttcatggattggaagatttaatgttgttaatatgtcagtactacccagcgcaatctacagattcatcccaatccttatcaaaatcctgatggcaatttgcagaaatagaaaaatctgtcctaaaatatatgtatatggaatctcaagagacattgaataaccaaaataatctttaaaaagaacaaagttgaaggtctcacacttcctgattccaaaacttacaacaaagctacacgaatcaaaagaatgtagctatggcataaagacagacatataaagaataaactaggccaggcacagtggctcatgcctgtaatcctaacacttttggaggccaaggcaggcagattgcctgaactcaggagttcaagaccagcctgggcaacacggtgaaaccccgtctctactaaaatacaaaaaaattagctgggcgtggtggcgggcgcctgtagtcccagctacctgggaggctgaggcaggagaattgcttgaacctgggaggcggaagttgtagtgagccgagatcgtgccactgcactccagcctgggcaacagagtgagactccatctcaaaaaaaaaaaaaaaactagacagcccagaaataaaagttcacatatatagtcaaatgattttcaacaaatgtaccaagaccattcaatgaggaaagggcagtcttttcaacaaatgatgctgggaaaactcagtatccacatgcaaaaaaatttaaaaagaagttggaaccttaccttataccatattcaaaaattaactcaaagttaatcaaagacataaatgcaagtgctaaaactacagaactcttagaagaaaacataagagaaaagcctcatgatattagatttagcaatgatttcttaaatatggcactaaaagcatacacaacaaaagaaaaaatgaataaattggctttcatcaaaatttttaaaatttatgcattaaaggacactgtcagagtgaaaggcagctcatggaatggtagaaaatatttgtaaatcatatacctgataagggattaaaatctagattatatagagaacttctacaactcaacaaaaataaaactcaaaaggaaaaggactggaataaacatttctctagagaagctatacaaatggccgataaacatatgaaaagatgctcaccatcactaatcattagggaaatgcaaatcaaaaccacagtaagataacatttcacatccattagaataattattattttaaaaacagaaaataacaagcattggtgtggatgctgagaaattggaacccttatgcattactggtgggaatgtaaaatggtgcagctgctgtaaaaaaaaaaaaaatagtatgctggtgccccagagagctaaacatagaattatcacataatttagtaattccacttctgagtacatacacaaaaaattgaaagcagggactgaacagatatttgtacacccattttcatagcagcattatttatagtaacccaaaagtggaagcaacaacagattaatggccaaacaaaatgtgatatataaagaaaatggatcggctaagcatggtggctcacacctataatcccagcactttgagaggctgaagtgggaggagagcttgagctcaggagtttaagaccagcctggaaaacatagtgagaactccacctttaccaaaataatttttaaatcagcaagctgtggtggcacatggttctggttttagctgcttgggagactgaggtggggggattgcttgagcccaggagttgaggctgcagtgagctaagtgagctatgattgcaccactgcattccaccctgggcaacagagtgagaccctgtctcttaaaaaaaaaaaacagacaatggattattattcagccttcaaaggaaaaacattttgacacatgctacaacatgaatgaatcctgaggacattatgctaagtgaagtaaaccagtcacaaaagcataaaaatagtatgaatccacatataggaggtatctagagtagtcaaacacatggagacaagggctgggggaggatatatgaggagttcttgtttaatgggtacagagtttcactttaggaagatgaaaaagttctggaggtggttgacagtgatggctgcacagcagtgtgaatgtagttatcaccccaaacttaacacttaaaactggttaaagtgataaattttttgttatgtatattttaccacaataaaaggaattttagaattaaaaactaagggtactacattatgaccatatagaattcatcccataaacacaaggttggtttaacttttgaaaatcaattaatttaagtcaccagaataaaggagaaaacccagaggatcattgacagagatataaaaatggacaacattcaacatccattccttatataaatataaatatatattcagcaatccaggaatagaagaaaatttcctcagcctgacaaagcgcatctaaaaaagacctacagttaacatcctacttaatgatgaaaaattgaatgctttcctcctaagatcagaaaaaagactcaattgtaagactaactagtttttctgtgagtgggaactattcaaatatgtcctctccttccacttttattcaacattatactagagggcctattcagtaaaataataataaagaaatataagacaaagatattagaatgtaagaagcaaaactattatatatgtacatagaaaatctatggaatctacacaaaaatctgctagatttaaggagtaaatataggagagtcaaaagttacaaagtcaatgtacaaaaatcagttgtgggtagatcttaagtgttctaaccaaaataaataaataaataaaaagtaaaaggaaatggtaactatgtgaagtgatggatatgtaaatcatttaacatttcaccatatatacatacgtcaaaacatccagttgtacaccttaaatatatacaatttttacttatcaattatgcctcactgaagctggggaaaaaaacaattatgggacttccatttttgggaagatggagttgacatatttctccctattccttccactaagtacaactaaaacccctggacaataggtataaaacaaacagaagtagacactgaaaggtagaaagaagaaagttgactctttagggacttcaggatccatggaactactcagtggtggcttctgtgggttttctttctgcctcacagatcccaaacttggagctgaagaaactggcaatctggaaacaccaatgggtgcagacagaaaaagctccaagaaaaacttgctctctccagccaaaggaccaggaaaggggtgcctagggcagaaaacatttggacaataacttctctaatccagctaaataccacagaaaaattattgtgaccccaccttcattccagccagcaagggcaccccaatctccccttcaagccagtgtcagaaaatgccaagtaggaacttccaccatagctcactggaaacagggtcctgtcccttcccctctccatgatgacagctcctgtgacctgcctggcaagccctttgagggaagtctggcctcatccattcactcacttagcatttagagatggtggccaatactcgggcctgggccttggggattcataaatgatgaaatcccaatctctgccttctaggggttcatagacttggaagtaagggttgacagttgatggaacaagttacagtgcaatgtaataggggaaggctgtggtgaaagaaggcacagggggctctacttccactggggagggactgcaacaccacagagatggggaggaaggcaacaattctagcaatgcttctcagagggggtgatggtgattacagagttgagtcctgatgagtctcaagtagcaagccaaacaaaaaagtaatgaaagtgcttcccaagcagaaaaaaatagcatgtgcaaagtcactaagacattaaacatcctgctgatggaattgggtatcattcttttggcctggagcatacagtatgaagggcaggtggaagaagatgaatctagacatgtaaggaggggccagatcatgcaagaccttgaaatcttgcatgtagttgactctcaataaatatttggtgaaagaataaataaaagtcttaatgggataagcaatcaattaacttcaagctgttttgaggttcaatcctcaagtctatcaggagccactgaaatgtagtgagaaagatgtagtcagatgggatatactagaaaaaacagcaggaaggaaggaaggctacatgcaccctagtgttccataaccctgcacagcatcagggcaaggtccttaacttcctagcaagtactactagggagcatataaagccttgagactgaaaatcttggtaacaaacataaacaagattgctcttacacattttcagacttgcaggaacagccagaactgttttgcctagagacaggatggtaacacaaccaaagaagactatggtcttttcattgcaacttgaaactcgacatttcaacagaatgcaacaaactaagctctgaggtcaaccatcttccatcttggctgacactgccctacttttgccttttgtagagggtggactgttttctaactgggtgtgtaatgagaacagaaatggattcctttagtatatcttgactttcctgatttaagtgggctgccaagaaactgagctaacaggactaatgatgcttcccaactactcccaagtgccatgactcatgatggtgggtaaagtctctttggcaaactgtaagcatggcaagctgtttattccctgctcctgttccttaagtctcctccctcctaccctgtggtagtcggcttgctgaccttagaactgcaacacttttcttttcactaagacagccaaatgcctaggcagataaaaaggcatccctggagaatctccgatctgccccacaagtttttacatcagatgcttgtgtgcagatgaagaaatctgcccagggcttctctgggcatgcccacagtggactggagcccagcatatgcactgggggaagtgggtggagccacagggaattcacatcttaagcagaggaggactctgctctcttcagctcctgtggtgacctgggaatctatctgtgaggtggagggcctgttagcaagactccatatcactttgctgagaggtttttttccttttttccttttcacccagtaaattcctctctaatcacccttcaacatgtctgtgcacccaatccttcctggtcatgtgacaagaacttgtttttttctacatttttggtggcctgtatggggacatgggaaaaggttagtaacatgcaaaccaaaaactgtttcttcctttcacttctaagcctttttgtcctcagacttcttctgagggtagagaaaattatacctctcccattcatgttgctcctgggggtcggtaatgtcacctttttccttcttttttggggatggacgggcgaaccggcagctccccagctcccctcttaagtttgtctcccagttggaggagcccattggcataagaataagaggttcttcccccaggcatctttccagcccttcactttaaagtttttttccttttctctaccctgtcagcagttaacacagccctgtactttaagctttctttctttctctaccaggtgatgagttaacttttaagtgaggtgtttttttttcttttcaaaatgttttactaggccagtaatgataaagttcactgtttatattctctgtaaagttttaattatgaaaaaggatttgtgagggtggtcttgagctatagccaatctggtgtgctttgtgtgtctttctatatggtacatagcaaactttgtggcagtcctccatcttgttttacctccttgggagcatgacctgtaaccacatagcaatgctttgtttagcctctgccattttacagtggtggccccgattcaatcctggcttagggaatgagtcctttctagtttgatatctttgcatcctttgctatttgttgactctctttccctccactaatccttggattttcctttctctgagccttaataaggtttgaaagccagagatattggccacttggcatggctaaaattggataataagggagttaaaatgattttcttaaagagtgctcagcttaattaaagtggatatccaagttataggtatatttaaaaggcctttatgtttttcttttcttggaccttgttttgctagaaaaaggtgttttctcagttgattgaattatttttctccattttgccttgccactcttaatgcacacatgagagtggggagacctctgttttcctcatggaaccccaggaattaaaagcagatagatccttctcaaaatctgtttttgccccacctatgtctgtttactaggccttagaagctacaagttttctgagccctgtcttttaaaggactccacctggaggccaataatccaattaggagattggcaaacaaaaaatcttacggcaactgggttttcttctacctgtctgtgtagctatatatgtgttgtatgtgtggtgtctatgaaaagagttctaattaattggcctaaaggaagataagcgcttggatcaaatatttttttaaagggaatataaagctctggtaccttttagttcacatgactgtaatctttgagaaataaaaacagccttaaagattattggtaaagtgcagatattgtcaaaatattaataggtgaactaaattatgcaggtcagatactaggtttgctaaatgttttaaggttataactgattttttgttttttgagaactatttaagtagcctgcttcacaactgataaggcctggggacatatggaactaaccacacccttaattatgctggaaggagtcaaacttggctgcacctagcacataattaaaacaacttaccaggttttacattaaagttaaaaatttctaggagctaccattataacatgtaattgaaactgctagaaataaatttacatgcaaggtgtgtaagaacagtaaaatatgtttttaatacaatattataagaaggtgtggaaatgtaaattcttgcctagggttaaaggattgttttgagttagataagataaagataaaaggtcaaacatgttgtgaaaggattgtaacaattaatattgccaaagaaattctgtgtgtgaacttacggactaaattcaaaaggatattatatggtttttctgtaaattgagcattgaaataaaagcacaacaagatactcttaaggcactaatctgctctttagcaaaatttgtaaaggattgtagaaggtttttgctttttcaaatttctttttttatttttatttttacttatttattttttttaatttaatattattatactttaaattttagggtacatgtgcacattgtgcaggttagttacatatgtatacatgtgccatgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttaaaaaattaatgttccatggatgaaattggaacattaattttttaaaaaaagaaatgaatttggtcaaatatatcttccaaactctatgcagttctttagtaagaaaatgaggaatgtacaaggcacaagaatccttccatatggacactacatcccagtgagtttcaggcaggagatctggtcactggcttggactcctagtgtagatctctgggctagactgtggcaatggtcctttaactgttctggctttctctgccctatccggtcatcaaaacccagggggcctttccttgcttggcaaatagtggacgtgataggtgttagtttctcttagccttcctgaactaatccaggcctcctttcccatttcatgtctcctgcctcctaaagtacagcttctgtgctaaccatgccacatttctcacccgtccaagacttctcaactgggaggcacttctacatctctttgatctcggttcagaattatgtgtaccactatctggtagctgacagagggcagggaccatatgggagattccctgtcttcccaagcccctaccacagtgtcagaccctggtttggtgggcgaataggaaagggagcagggtaaggatcaatttaatattgtgatttagtgctacagtagcccagataaatttctcctttgagctgccttagcatcacacattttacatttccaaatagctcatgtaatgttgcgtgaccctgggagtgaatgcctccttaaatgtgccctgggcactccacttgctacatcttagttccagccttggttgccaattctctttttatgtgggatctcaggcaagctgggccatctctaagttgtgttcctgggcctctgcaataagaaacatcctggttcaagtcaaccagagagccccctggctccatgcaatttatgccatcttgtccatcttttaaaactggtatccagtttgatgaactgtgttcatctttttaaactggtttacatgagaccctagaactggcctagccagcccaagtaaagagccttgggcactaagtctttccattctgaagcagttactactgcccaagcaatcttagggtagcttaaatcaaaagcacaggctgtaggcacggaactttaaaatgtttttataggagaaaatgtcttcacctaaagattgtgagcaagccatgtttttgccctctggtcatttttgggtttttttttttttcagcatttgtgtaattatttgtggcttcagttgctatgaaaaaaaaacaccacttaccatgacaactataacaattttgtctcaataatatgaagcttcaaaaatactgaaatatgtaggactctaatatccctccttttttaaaaaatcaacaaaatgttcttctctttagaaaagccacctcactattctccactttctctgtgttgcttgtcacagatagccagaagacttcaacaaggaatacccaagggctaaaatcaaatgaaattttcataaaaagccaggtcattaaaaaccaaagaatgacaaaatagagatttatcatggacatattctgaagatgtgtgcaggttcttttacatacaacttttcattttatcacgattttacctcattttacagaagagaagaacactcagaagttcaatcactcgtccaaagaggcagggcaaacccagggcagatctgcttgagtgatcattctcttccggcttatcacagcattgtttatttaagcagtctggtcacctaattattataatcaagcgaaaactgagcgttcagaatgatctttttcaaatagaaaactaagagcttttgttaaaaaataaaattgatccagttactagtcttcctgtaggtatacctttggaacaactaaaatcccctctcacctggctccctctgccctaagtcagttcagaaattgcagggttagggaggcagggaacccctgctgcaacccacaagaatggctatcaaaaggacaaataataacaagtgttgatgaggatgtggagatattagacctctcacacactgctagtggatatgtaaaatgatgcagctgctgtggaaaacagtctggtggttcctgaaaaggttaaacacacagataccataagacccagcaattccattcctaggtatatgacaaagaaaatttaaaaatttacatccaaagaaatacttgcacatgaatgctcctaattcatattattcataatagccaataagtggaaacaacccaaatgtccatcaactgaagaatggataaacaaaatatggtatatccttacaatagaatactattcagccataaaaatgaagtaccgattgatgctacaatatgaataaaccttgacagcatatgctaagtgaaataaaccagtcacaaaaacacaaatactgtatgattagcttatctgaggttcctagattagtcacattcaaatagactgaaggtagaatggtagtggccaagggctgggcaagggaggaatggggagttagtgtttaatggggacagaatttcagttttgcaagatataaagacttctggagattgattgcaaaacaatgtgaatgtacttaccactattgaagtgtacacttaaaaatgattaagatggtaaatttcatgtgatatgtttttaccataataaaagaatagcttctatttatacgaaatgtccagaatgggcaaatccagagagatagaaagtatattagtggttgccaggagctgggaggagggagactgggaagtgactactaatgcatggggtttctcttggtggtgatgaatatgttctggaattacgtaatggtggtatttgcacaaccttgtgaatacattgaaaaaacactgaattgtatgctttaaaagggtaaattttatctcaaaattttgatacaagacaataaaagaatctagaagtaggagctggagtgtacgccagagatgaaaggaaaaggaaagataggaaattgatgattatgagaaactatgcaaaagctacacattggcttccctgctcacaaacgtctcattgtctgcaggtgcagacagtcatgcaccacagttagctcaaaccaagagtgggcttcgtggctggagataaaataagcaaaatacatatccattatgattattttaaacatgacacaagattgccgtgaaacccagttgataactactcctaatggctggtcagtggctaactaacttgaagatacaaaaaataattataatatgaatagatactaatattctatttgaatacagcctaatggcacttatatgtcctaattccatgcttttctaataatatctgcctcattctcactactgatgttggataatagaaatctctgtggacagctaataggatactagtgtaaattaacaatagccgtcatttaattaagctatttgagaaagtctggttcctactggacttgctagaagtacatcaaacctcttgatttataacagtgtagggcatgagttcctggctgccccataaggaaggaaactgccagaagccctttagaatgaagaaaagtgagaagattcttggaaagtggactgagcttttaactctgcaagggaccctcagccctcttggcatactgaagtgaacactctgcagctaagcaccactgaatccagcaggtaagcctcccctcaggttcatcttgcaagattggcttctttgcttttcctttttcaggtaagttattctattcctggcaatgaataaaatgaccaaggtgaatgcatacagaatgaagctaaagtcatgctagagatagtgtcaaatttaagtagatcatagtacagaatgaagagctcagagacccagcaagacccagctatgcatgggattataggatacaataaatatggcatcacaggttatggaaaagcatggatcagttagtagacagtgctgggaaaattgtcttattatgtgcagaacaatcaaactaggttcctctctaacaacctatatgaaggtggattccagatgatttcaaggataatcatgggccgggcatggtggctcatgcctgtaatcccagcactttgggaggctgaggtgggtgacctcctcacctgaggtcaggagttcgagaccagcctggccaacatagtgaaaccccatctctactaaatatacaaaaattagctgggcatggtggcgtgcacctgtagtcccagccacttgggaggctgaggcaggaaaatcacttgaacccgagaggtggaggttgcagtgagcccagatagtgccactgcattccagccagggagacagggcaagactccatctcaaaacaagcaaacaaaccaagaataattatgaaaggaaaaaatggtagcaacaaaaaagaaattgtaaaatattgtttttgtcttggaatgggaaaggatttcttaagactccaaaacccaaaatgtgaagtcaatgttaattgatttgattgcattacaattaaggatttctgttcatgaaggacactacgaacaaaattcaagatggatggcaggatgggagaaaatatttgcaatatctaaaaccaagaggaactaactttaagctagataagacacttgtaaaaagcaacacaaaaaaagaaagcataatagaaaaatgattaaagtataaaggagcagtgatacggtttggctctgtgtccctacccaaatcttatctcaacctgtaatccccacgtgtggagggaggtgactggattgtgagggcgttttcccccatgctgttctcgtgatagtgagtgagttctcacaatatctgatggttttataaggggatcttctcccttcactgggcacttcttcctgccaccttgtgaagaaggtgccttgcttccccttcccctgattgtaagtttcctgaggcctcccaagccatgaggactgtgagtcaattaaacctcttttgtttataaattacccagtcttgggtagtattttgatagcagtgtgaaaatggaaaatacaagcaggtaatttataaaggagttaacccaaaaagcaaacacacatatgaggagatgctccaattcattataatcagagaaatgtaaattaaagcaactatgtaatatgatcttataccttctggacaggaaaaattagaaagctggagattaccaagtattgacagagctgaggtattataggaattctcatgctttgctgtgggaacatagacagggccagccaattgcaaagaaatcaagcaaatactgctcagttcaattaagtatacacagtctccatggtccagcaattttgcctttgtatgtatgcatatatgtatgtacatgtgtatgtacatataggggtatgtgtatatatatataatattaactaatagacacatgttgatagcagcattattcataatagccaaaaagtgaaaacaagccaaatgttcatcaactgatgataaataaaatacacccatataacaaaatgtaatttggcaataaaaagaaataaagtggcgggtgcagtggctcatgcctgtaatcccagcactttgggaggatgaggcgggtggatcacgaggtcaggagttcaagaccagcctgtccaagacggtgaaaccctgtctctactaaaaatacaaaaattagccgggcatggtggtgggcacctgtaatcccagctactcaggaggctgagccaggagaatcacttgaacccgggaggcagaggttgcagtgagctgagattgcaccactgcactccagcctgagcgacagagaaagactctgtctcaaaaaaaaacaaaaaaagagagaaagaaagaaatgaaatattgatataggctataacatgaatgaaccttgaaaaggttcattatactcagcgaaataagccagacacaaatggacacatgttatatgattccacatagatgagatatctagagtaggcaaatccataaggacagaaagtagattcatggttgccaggtgctggaagttggggacatggaacttcgctaacaatagatttgttattgcttttttggatgataaaaatattctaaacttagactacagtaaaattgcaaaactctgtgagtatactaaaaccattgaattgtatacctcaaatgggtgaattttatagtatgtgaattataatacaataaaattgttataaaaaaggaatgaatgaatgaatgcatggaatagataaataaaaacttaaacagggtttgcatggacttatgatgagaatgtgcccataacaaaagagtgtgattaattcaatcctctgctccagtggtacctgcctctttttttctgactttgctgatcttcctggacattgtagatttcttaaacataggatattcttttttgactttctcctgctcaccttgtcccaagtcctcagctcttcacattctgggcctgggttgggccttggtctgaaccatgcttcagatgttgtaggctaagcagagcctggtgcagatagaggacatggtagacaacttctgacatggctctcagtgatttctgcctcctagaattcatgaccttgggttatcccttcccccttaagtgtgggctggacttagtaacttccttctatccaatagaatatggcaaaagtgatgggatgacaattttatgataagattacaaaagattgaatttcatcttgctatctctctctctctctgtgtctctctgtctcttttattgttactctctcttgctctgtagcttgcttgctgttatgttgtaagataatttatggagaggcatacatggcaaaaagaaacacaagaagtgcctctgatcaacaggtcatgaggaaccaaggcctcaaactaaaaacctttaaggaactgaattttgccatgtatcatgtaagttatcccaaaattgagtcttcagatgaaactgcagccttagctgacacctcgattgcagccttgttagagattctaaaatcagagaacccatctaaatcacaccagaacatctgacccatggaaactgtgagataataaatacgtgttaagacattaagttttggggtaattggttatgccacagtagagtggtagacaacaaatacagaggtcaaagcgtgttaaatatgctccttttctgtcaccagaactttggaactaagcttctcttgcagttggatggggttaagtgcctggcccataacaatctctcaatttggtgatttgtttttacagttccaaacccacccttggactgggcatggtggctcatgcctgtaatcccagcattttgtgaggctgagacaagagaattgcttgaacccaggagttagagactagtctgggcaacatagtaagaccccatctctacaaaattaaatttaaaaaaaatagctaggcatagtgacatgtgcctgtagtctcaccctccctgaggtgggaggattgcctaagcccgggagattaaggctgcattaagccataatcgtgccactgcacaccagcctgggcaacagagcaagaccctgtctcaaaaacaaaaacaaaaaaacacccttggcttcccggtaccctcagagtaaaatccgaaataagtctttactgtagcctacaaaaccttacatgatctggtccctgataccgttctggactcatcctactctcccttcaccctctctgccccagacacactggtatcctttctggtcattgaaacaagtatgttttcactttggtggcttcaccttttggtttctcattggaaaggtaatccctgcaagatgtttaaataactcaccacctcacttcttgcaggtctctgataaaatactatctccttaaagaggccttttccaataaccactacagtaagctccaattctcaatctcaattcgcttctctgattttatttttcatgatagaatgtatcactacctaaaattgtatgtacttacttgtgtatttgttctgtctcctccctatagaaagtcagttccatgagggcaggggctttcttttgttcactgttatatctccagtgcctagaaccgtgcctggaacttatggccagatcagggaggagggggtattgggagagatgacaagtcacttcccagagacattgtattgtgaagcagaaaggggcaaaaagcacccagagagaaacagttgcacattcagggagctgcacacctgtccgcatcaccagggattcttgggattcttgggggatgccagaacatgtagcacaagggcagacaattctcagtatatctctcaccttaactgtataactagttctataaaaaggtattttagatggttgctcaataggcttatcttcatatgcggctagaaaatttactctttatgagggctgctttttctaagttttctttatttgcattttgttctttcatgactaattatcatgtataatttaactgcatggtttaattaattgtcaaaatgcaaaagtgcaaaattttatgtagaaataattactgacacaggcaaacacttgttactttagaacgaacagccggtagctaattttgctcacaattacctagttgtaggtttagcaacatctgaatttgttatatcttcaaaagagattccatcttttttaattaattttttttctacatttgaaagaagagtacatataagcaaaaggttaaaacatgattttgtaaaacacggagaggaatactatgtagagtaaaatctaattagaacactaattaatgagaacagataaagtaaagtttaggactgtgtttattgttgcagttaacagattctataatattgacaaaattcaatgggcgatcgcaaacatttatgaaaagcaaaaaacagaaaaaaaaagtgaagtaaatgaatgcattgtccggtggttctatatatcatgaaggcataaatgaggaaggaccaaaacaaagacaggttagcaaagggagctaaggaaaactgtggaactcaagtaagaatttggaagccctagggatgcaatgttgagggaaataaaatatcttgattctctgtggtatagttacacgttgaatgactaattctattagaaggccagtcagttcttggaaaacagtatggacacatgtgagcacagcctttgacacagcgacctcctttctgatcataatctccaaagcgggggagaacctacacataaagctacttgttatagttttacacaccatatgaattattctgggactgaatagagcatagtaaaatgaatattataaaataaagagatgactttatggagattttaacaaatgaggaaaattaaaaggctgcctcattcactatcacgtttgtgtttttgtcagaaagcagttaaaagccaatttaaaactttatgtcatttttcatgctgaattttctactttgatgtaagaggaacaagagttattaaacaccttggttggagaaaagacatatttttggcagtttttttctcatggtgattttgctgcttatggtcaataaacttgttaatcagcattaattcagctatatagtttcaaatattctgaatgaaattaaatcaaatatatttgttaatatttgatttttaagatagcatgcagatgatccttttaaattctactatattttatacaaatcatatattcggggcatagcatacctgctaaataaaagtccaatttaaaaaaaaagttatatatacattacctatatctattagcagctgaaaagcaactatatcactatcaataaatttgtgctcgtgcattatttgctgaatatttgtgaagctgaagctgagtcctttctccactagattattattataatttttttttttttttttttttggtgagacggagtctcactctgtctcccaggctggagtgcagtggcgtgatctcagctcactgcaacctcaaccgcctgggttcaagccattctccctcagcctcctgagtagctgggattacaggcatccaccaccacacccagctaatttttatatttttagtagagacagggttccaccatgttggccaggctggtctcgagctcctgacctcaagtgatccacccacctcggcctcccaaagtgctaggattacaggcgtgagccaccgcgcacagcctccactaaattattcttaaccagaggaattaagctagtgtctttacttctcaatttaattctataaaaacactttgaatatctactatatacaaaacaatatattttattagcagcatttcatcagaaatatttcagcagcaacatttcagagctatgtgatgaaagaagttcgtggtttggactggggaagttggtgtttacacgttaatcaaatgaaatgcaccattgttttttcttcttttctttttcttttttttttttttgttgttgttgagagaggctctcactctgttgcacaggctggtatgcaatggcataatcatggctcactgcagccttgacctcctaggctcaggtgatcctcccacctcagcctcccaagtagctgggattacaggcatgtgccaccacgccggactactttttgtattctttgtagagatggggtttcgtcatgttgcccaggctggtctcaaactcctgggctcaagcgatctgccagcctcggcctccgagagtgctgagattacaggggcaagtcactgcacctggccaaactgcaccattctttaactatctttttttctaccttccagtttcgagtcagaagaagctttatttattttttattgtatagtattattattattattgagacagtttcgttcttgttgcccaggctggagtgcaatggcacgatctcggctcactgcaacctcctccacctcctgagttcaagtgattcttctgccttatcctcccaagcagctgggattacagtcaaccgccaccacacctggctaatttttgtatttttagtaaagacagcgtttccccatgttggccaggctggtctcaaactccagacctcaggtgatcagcccaccttggcctcccaaagtgctgggattacaggcgtgagccactgctcctggcctatttatttatttttaaaatggggtctgattctgtttcccaggctggaatgcagtggtgcaatcatagaaagaagcttttgtgaaaaggagggtgcatcattgttttcagattattgatataactgtgttctttctgtgtctatatctcagcttcatttaaatcccactcaagcttcacctccttaattaaactctgactcattttgcctagccctgatttttgcccttctctagctacctttaatatcaatcctgtgttggatatcttttttgtattgaattatctatttgtggttataaacattctctaagacttacttctctagccagattgtaattttgttttgcaagaaatggggataaggcctgctatttttcaatgctatcctactgttgggcatgctgtgagaatatcagtaaatgtggatggattgctcgataatgctgcagtataatctgcaaataaactctaggcaattgatgtacatattaactccctaaaattctggaaaacctataatcagttgttcaaaaatgtagtcaagtctcagaaatcctagaagaggctaagagttgttctaaaacattcagaaattaagtttaaagagtatttcaaaagacaggcatttgtgttatttccattcgaatgaaatacttttgttatttcatttaccaacacatatgaagatgggaaaacacttaccagaagtctgtgccaaggaagagatgcgaatgatatgcaaacaggatgctactcacctgaaatggatgaggtaaatttaccttaggaccaggtctccttggttcacctgtttcttgcctacctcacctccttaaacttattcacacacattacttagcaaagattaccttgctagctcccaaatgtgaaacttcagcctttcttagcctgatttatcattacttcagaattttaaaattaagaatctgtcatgtttgaccagggaggaaactcacggctggtcaagccaaaacaaaacaaaaaaatctcccggggagcttgacttagtggttctcccctgaaggaaaatgaccaagccctgcctaatgtcagcctcagggaaagccttcagaaccaggaagaaggatttacaaattcttaaaattgcttttttgtttatactttaattttgaagactcgacaattactttaaattctgctcagtgccttaaccagagtgtttccatattgaaagcattaagtggaatgacttctggctggaaaacacaaacaaattttagttatctcaatcactaagaaccagagagcaaggcccaccctgcctggcaaacaagggattagcttcgtggctcttggggctaggagaaaatagttaatgaactggctaatattcactgtctgctgagtaatttgctgactcctcaagccccacatccatgttgtgagaagaggaaactctcagtgatgttctttcagtatttctgaacccctccagtaataaatcacttaataatctaccagagagagaatatccgatattaacatgcatctcaaaagctacaagctgccctgtgcatgcaagcaatagggccctaaaaacagtgccttaacaaaaatgttcaagacttaacaaaatgtttgagcccgatttcctaaaacctcctggctttacattgaataggatgcaatcaactttgccttacaggaaatggagttttgtgtccttcacttacctgaatgcagtatttattcacacctaatacttgaaaatgggttaatatgcaacattggactgggggactggataatgtttagcgtcaggcacaagagtagaaaatgattccctctgaatgttttcaaattatatacttccctactgatgtggtaaaataagctctaatttagatagcccctctggataatgttgcatgttggtttgttgttgaacatccacatatctctttcaactctaattatttgtttatttgaactagtcttagctctggtaaatggtaaaatgtgaagggttaatttcagcagatgtttgaagccagctctgtctaaagctctgtagggagcctctacacaagagccgtgtgtagggtgagggggaaggggctagaggtcagggtcataggtaaatcaacaccagtttccaaggaatgaaagcagaagtaaatcagagacctggaagggtctggtcctgggaaatgagaaagaaagatgttatatgaggagttacaaggttggaatagaacacagagggaggagatgatgcatgaagataaagactgggtagctgagggcaaagagatgctaaaacaacaacttactgaatggaagggccagaacagggctagatcaagcctgatgattagttggtgccttctataagaatgaggtgcaggaagtaggatgtgtgtactatttctctgctagttattgctacccagacactgtcaacctaccattttggaaatgcatctccttaatcacaaaaagaatgtagagagagaatatgtaaggttgaattacctacctccatccacatggctggacagacagcacctactgcctatgattcagcagcaacttgatgtatgaagagccttttgagcattcatttccattcttatctcctatggaacaactcaaaagggacccttgcccctttgttcatttcaaaatagattaatctgcatctgagagaagtatctaacaaataggaacagatgatctatcggctgattcgtgagctattaaggcagccagtaccacataaatacaaagactattcaaaggaaggtaatatctctgtacaaaatggtccctaccaattaaaacttcggaaagttgtctttgtccccatgtggaacagtatagttgttaaataggtgctactccattatgttgaactttaaattgaatattcaaaatatttacatagtacttcttcaaactagattgaaaatttcaaaaccatatatatttaaattacactgtcattgtgtgaaattagaggacatggacaaaatgttatgtttgttggagactaagtgaccctttcattagaacttagcaatttcgaaggaccagttaatcaacagagaggtctctggaggtatcatttgtgctttttaccaatattacgtcagcattgtattggcaatggtgtgaagagtacacattgtgctttttgaaaacagagactgataggaattattttccttataaataatgcatgagaaagaaaacagtctgtttcactattatttttcaagtactttattctaatcattttggaacaattgaacatacatcatcttgtctctttttatgattataagagcaatacatacttattgtagaaaaacaaaaagtttgaaaaacaagtttcaaaaaaatctcattaagcagaggtaatcgtcaatactatcttggcatattcccttttatttatatttgttttacatgattgaggccatatcgtacatacaattttatcttctgattttagaagttaccattataataaagttcttcttcatattattaaataaaattatacaacctgattttaatggctgcataataacaagttgtgtggagattcaataatttatgttaaaatagctctactattgtacatttaagttgtttctgcatcttctctcaaacgcagatcaatctattttgaaatgaacaaaagggcaagggtcctttttgagttgttccacaggagatgagaatggaaatgaatgctcaaaaggccctaaatacatcaaattaatgctgaatcacaggcagtaggtgctgtttgtccagccatgtgaatggaataggtaaaccttgtatattcactccctacgttctttttatgattaaggatgatgtgttaaccatctttgtgcataaaactattgctttagaatagtgtcaaagaaatggtatgcataatactatttccttagagtcaaaaaatggaattattaagtcaagaaaagtcttatggtccttaatacacattgccaaattgtttaactgaaaatggctaaaaaaattacttttcaaattaaaaagcaggtgatttctctcagctgtcatgcattatttgaaaataatgacaattacctgtttgtttgctatattaaaaaacaatatatttgctatattaaaaaaaaaattggccgggcacagtggctcacgcctgtaatcccagcactttgggatgcggcggtgggtggatcaccaggtcaagagattgagatcatactagccaacatggtgaaaccctgtctctacaaaagatacaaaaattagctgggcatggtggcatgagcctgtagtcccagctactcaggaggctgaggcaggagaatcacttgaacccgggaggcggaggttgcagtgagctgagatagcaccactacactccaccctggcaacagagcgagactccatctcaaaaaacaaaacaacaacaacaaaaaaacaattaagtgccttctatagccaatcatttccattaggcaccggatttaattcatggtacaagcccctgtgagctaactatctacaaagtttttgtggaaaagatgcagtccagcatagtttttgatagaaaagagagtagaattgaaaaagaaattgtcaagaaaaacctggagatatttgtaattttatctgaaaagttcttatttttgatatgcagtagaacagatcctagcttgggaggaaagagtcacagattagttactaattactatggaaactcacgctggtctctaaatttctttggacttcaaatttccaaatctgtaaaataagacattaggtcagaatcctacttcacttaaaaataccatattgggttatattttcatgtggaatctttcagacattattatgatacaaaaaacaccattgtctcatgcctgctaataaaccagaaatacagtctgggagacctcggattagatataggagagacacttttacatatgatgagcatgatatagtaagaaaatgatattgactcacccagaaataacagtgatattactatgcccatcttacagtttatttttacattttaaggatttaactctccttttatctggattcaaaataaccacctagttgaccatacctgtgttaggaactatgatatttatagaatctgaagataagatattccaacacaaaccctttaaaaatgatttttgcggaataagttgattgattacagaagttatccatatggataatttagagtttgactatgaagactggagaaaacaaacaccatttagtaaattctacaactttttatattaacatttctgatcaagtcagcgcatttctttgttatgaaatgaatttaggatctactacttaaaaaaaagacagaaggttcccttttccctgatattttaatactgtattaaatttgtcataatcactctcttgaaaaatatcaccttcacttgactcctaatattttcctcagaatcaatcagacacggaagttcaaaagtaacgttgaattcttcatttttagcaatctgtaagaattacattagccttcctatgaagaagcttctttgcagctagtaaaatagctgaaatagaagaaacagaacggaatcaaaatctaactttgagagtctgtaaatgaccacaaaaataagattagagaccaaaaagacctcagacttttcaatttcatagcttcatcaattttaacacatgtattgatatatccaaaggtggacgtggagattattttatttctataactagagagtgtagagctccgaatacagtctaattggtatattctaaagtactggatttattatttggatgctgggtctctccatggctccgacaattttgtatttatctcaattttaaacaaatcaatttccatttctaggtatcatttttctgattgtgccagaggatagtaaaacgtggcacttttctactttaaaaattacttttcacaacgactaaattcttcagtttaagttattgtctgaccaagttttaaatataacttaactttaaaaggggccatatttacttacaatgtaactttggttttacattttagtcccagactacctgatatcaaatagccagtaacctaacacatataaaagtatttctattaatagaattctgaatgtctctgagcactgaggtatcttggtaagcatctactttcaactccttttacagaagggacttcaggagcaaagagggcatgagacatgccccaggtgacacagggattttttgctaaaactaagctacatgtctactgattcacaacctagtactcttctcattgcactatactgccttgcagggttttttaaacattagaaatccctatgctgggatattttaaactttggtcaagccaatacattagaatcactttatacaggaagccagatacttttattactattagccaaatattttatagaacaacaggtctggaacagaaatgtaagaacaaaagtttaaaagttaaatgtctagtaataccccacaagcactggcaaccaaaaccaaagtgaacaaatgagatcacatcgagttaaaaagattttgcacagcaaaggaaacaatcaacaaaatgaagatacaacccgcagaatgggagaaaatatttgcaaactacccctctgaggacgagggattaataatcagaatagataaggagctcagacaactctataggaaaattatctcataatccaacagaaaatggacaaaatattttaataaacatttctcaaaagaagacacacaaatggcaaacaggcacatgaaaaggtgctcaacgtcattgatcatcagagaaatgcaaatcagaactataatgagatatcttctcaccccagctaaaatggcttatccagaagacaggcaacaacaaatgctggtgcagatacagagcaaagaaaaccctcatacactgttggtgggaatgtaagttagtacaatcactaaggagaacagtttggaggctcctcaaaatactaaaaatagagcaactatacgatccaccaattccactgcaatttcatggacagtgggccaagaattatgagatatttaaggaaagttgcttacatgaaacacaagaccaaaagtaaacatagtaaccaacaaaaacaggaaagttgaatgaaacagagacacagcagggaacaaaataaaacttcaaagaaatctacaaatgatgtcatcaaagacacaagacaatattcaggtctaatttaggacaaggagggcataaaaaggggcatttagaaaccaagaataatatcttggacattcaaaatatgaagggagagggggagagccaagatggccaactagatgcagccagaaagagtttctctcactgagagagatcagaccgtcaagtagaccagcacactccaaacagatcttcagaaagaaggcattgagagtggacagaggaaagacgcagacccccggctgaaagagaaggaagctgggaaccctgcacagggttgccaagaagcagtatttagttcctgcccctgagcaactcttagggaaggggtgagtgaaatgggcatggagtagcccaattttgccacggacctctgagattctagctgcaggagaccccacaaccaccatggacatctgaactggcagggagaacttcctggagaattggcagagacacaactctagcctgcatggagcccagagggtttggcgcaggagcggctgcagtggagcatggccgtggacgcccactcctcaagactctccatactcctctaggtggctctagcctttgttagctgctggacctggacagagcaaggctgtcttagccgtgggatggggccagtatgatctgagtgccccctgtctgccgacatctaccaaggtccctgcctagccacagccgtttgcagcgcagcctcagcttcccagcggccactgccatagttcttttgctggcagatcctgcccaactgtgagagaacttttgcagacggacccccaccaccttgcacctgcagccttgcctcaccaccacgcagtcacctgcagcctcccacactgtcccgcctacacacgtacatggggacctctgccaccctgcatatgctcacacacgggggcctctgctgccctgctggagcacttttgccagcagcccccatcacagtgttgttgccatggacacaacacaaacactctggcccctccatcacagcgggtgcttaacctcaaggggccagagaacaaagttgcaagcctggtcccagtcccccagggtcacagcatgtagcccaggagtgctgagctgacccttggccttctgaaagcaacctcgcaagaagcagagccagcctcttaagtggaaatttgcctccagtgctcagtcccgactcaatccttatcctccttgtctgattaactgtggacctgtcagtctgaccccaatcccgcaacacccacctccctcgcttgccacacaccacctcctccctccttccctccccaccatcctagaacatgcagacactcaaatcattttacaacaggttcattttattttcatcaccatgaggggtaccctgttgtgtgtaaaatgtaccatagacccttttggctatttctctggggttagacctatggagacctctcagatagatctagtcctttgaacttgccctgaaattactggctgtccagggagacgctggagatggtggaagtctcctcactttcctggtcctgctgtggctccttttgattgagttcctcgttcagctggtcagagtggctggatagcgttggccctctcccttcctcaggttttcttgaagcggcggtctttcgggagtggcttttttcctggaactccctcaaagactctcttttcccttccgggttgtcttgggaatctggaaggacaacagggagatcacagaagggcattggtttgggggaagaggatgggggaggggtgggaacaggggcttcatgagaagggtacaggctgaggtgggggttgtgccaggcgaggacagggtaaggcgtcttgggagggaggagtagaggggaaggcagggaggaatcaaggggaagacaaggaggagcctgggtgcgccactcaccttcagagggcttctgaatcttggttgagagggggccttcctcttcttcgcctctttggtgttgtgggtggttgtccctcgacaactgggttggaggcttgtgctttactggccatcttcaccacatcagcatctcccaactgtcttctctgggtcacctggcctccctatatataacccttccaggacaatgatgagccacacccctaagctttgattggccagcaagccattacccagccaatggtaggcctgcagggaggggcttagacatcacaaaaccccatcaggacattgtcatagggaagtagagagtagggggaggggccaggcatggggaagaggaggggacaaggggaggagtggggagtcttatgaggaggccaggctggttgaaacaaaaaaggggcatttctttagcactcctaaaaactttcccaaactgacctagcaccctcctcatcttctcatgtcagttctggtgagtcacatggcaaggatagggtgtgtcttccaaagcctttctctactgccaacccattcagtggtacattctgttttcttccacctttaaccattatctagttgttgcatgtcttacctacaatctattcatggtaaaaatttatgctaatatgtcatggccatatttaagtgtctgtggagatgtcaatcatccagttcccacctacaaatcctctaagcattttgaaaaccattaacttcttggcttactaccaagaaacttttttattccacgtaccttttctagtgtccatttagctctcctcagttttctattctccagtctgaaaccaccgccttcagactatgaagacttcagtgaagggctgtacatggtggctcatgcctgtaattccagcactttgggaggctgaggcaggaggattgcttgagtcaaggagttcaagaccagccttgacaacatagcaagacccatctccacaaaataaattagttgggcatagtagtgcgtgcctgtagtgccagctacttgggacactgaggtgggaggatcacttgaactcaggaagtcgaggctgcagtgagccatgaacatgccactgcactccagcctgggtgacagagcaagaccctgtgaaagaaagatgagagaaagagagaaagaacgaaagagtgaaagaagacaaagaaagaaagaaagaaagaaagaaagaaagaaagagagaaagagaaagaaagagaaagaaaagaaaagagaggggagaggaggggaggggagggacttccttgaatagacttgctcttctgggtatcctatccttgtttcaactctgcttatctcaacaggtataatactctggcttgagttttaacagtgttagggggatgaggcagatttatacatgctccaagttgtgctgggtgtttgcatgaagaaaatcacaacctcaaactgatgaatgcatagaggaaggagcttggcttaaccagagtcatgcccaccttatgtgaaaagctcttttcaaaatgtgccctcatccaccagataattttcttatcttattttattgttttctgttaacatcctacttccctttcttctcctgaggtcttctgaagaaatagagcttaccttaaggggaaacactcatagaattatttttcatgaacaattataacaagcttccaacttcttggaggagacactgtgtgatcaatttcagttcatttacctccctaagtacaggacctctcattcaggtttttgtccctggaagaaagggatgatagagttacgcacaggctgaagtgactgcgttaatatacaaaatctaatgaaattaagggaagattatactaatataattaatataatataggaatatgtcaatataaggataatgacatataataaagaggtcatctagacatgatgtttcccaacccccaatctaacaacagaaggcagcccattcctccctaggattaaatgggagctcaatcaacaacactagggaggttagcagcatcagcagatgggattaatccaaagcttctttgacaatttgtggccaagagaaatgttcttcttcaccattgtgcataagactcaccctctccctagagactctaggagacatttgggtggagacacagagccaaactcctgatttgaaatcactaaaaattaagctgtgcttttcctaagtccctgtaaactgaagctagacaacttaaacttcagatgaaaataacaataacctatttatgtatataaaccactttcatacctgcctactgatgtatggatttcagagcaatatggcttacagtcattttctaggattgttctttttcatttgattgttgcttcccttatcttttcctcccctcattttttctttgtaggacttgagacttcatcatctgccaaaaatgagctttcctaacaacatgggacctatttgtctaaaaataaactgtcctagccacaagagatgagacaaaacccaagaccacagactcattttcttctaaaatgctctgtctgaaagattttaagaagaaaacgggagagaaatataaaaagaaaataaaaacttgggaccccaattcactatgccaaaagggaaaaaattaagctgaaagctgagtaatgcaagaagctgcctttctttttgttcctaagcaaatagctacagataaaaggtttagtatctccacaggtagctactctaggttcactttatcttatgtaaagtgctgatttgcagagcatgagatgaatacatagttgacccttcccctaaccgctccttttctcttgcaatatgtggattcagtaatgtgaccataccctacctctttcccctccagcctgcttttccccattaaatattgaagccctcaaaataatacttggagaaaggcatagacatatcacccaggtgggtccttaacctttgcaaaataaacttctaaattgattgagacctgtctcagatactttttggtttacaatataatatgaaaagtattctttaatctgcatgcatggaaaactattcatactggaaaataaaatgttacctaacatattttaattaaaaaaaaattgcaaccacctcaaaattgaagaagtaaaaactcacaaacaacagatcaaagaggcaataaatgaaatattatagactataaaataatgaaaagcaatacagtgaatatcaagtctatgaaatgtatctaaagtattcagaggtaaatagataccttttaatatttttatcatttaaaaagtgaaaaaatgccaatatcttggaaaaaaaatattaaagcctgaggaccattgttgggagtgatgggatgataacagtcctatcagataatgaggtagtatgatatatgttataagcactggccttaaaaccaggtgacttgcatccatttctcaaccctaccacattcatagtagtatgaagttgggcaagatattgaacttggatatttaattttctcatctggaaaatatcagcttggcaaatattttctttttctttttcttttttttttttttttgagatagagtctcactctgtcacccagggtggagtgcagtggtgcaatctcagctcactgcaagctccgcctcccgggttcacgccattctccttcctcagcctcccgagtagctgggactacgcccagctaatttttttgtatttttagtagatacggggtttcaccgtgttggtgatggtctcgatctcccgacctcgtgatctgcctgcctcggcctcctaaagtgctgggattacaggcgtgagccaccgtgcccagccaaatattttctgtaaagggccaggtagtaaatattttaaactttgcaagctacattaaatcgtctctttcacaactactcaactctaccatcaaagcacaaaagcattcataaacaatatgtaaatatcaagtgtggctatgttccatgtgtcccactaaaaccttacaaaaacaggcaactggaagcagaatttggtcccaggtcagctgtggttatttggctcctaaatcacagtgtttttcataataattgactaaaataaagtctgtaaaatactgtacaggtaaaatcagggtagtgtagacaatacatacacacacacacacacacacacacacacatccatatatatataatcattgcattccggactaaatcccacttgtcatgttatataacccttttaatatgttggcagatttggtttgctatcattttgttgaggatttttgtgtcaatattcattaggaatttttctttttttttttttgagacagaagtctcgctctgtcgcccaggctggagtgcagtggcgcgaactcggctcactgcaagctccgcctcccgggttcacaccattctcctgcctcagcctcccgagtagctgggactacaggcgcccaccaccacgcccgactaattttttgtatttttagtagagacggggtttcaccgtggtctcgatctcctgacctcgtgatctgcccgcctcggcctcccaaagtgctgggattacaagcgtgagccatcgtgcccggccaggaattttgatgtatagttttatttttctcgtgatgattttgtctggttttggtatcagggtaatactggcttcatagaatgtgttgggaagtgttctttcctcttctagtttttggaagttttagaaggattggtgttaattctcctttaaacatttggtagaattcagtcatgaagtcacgtggacctagcctattcattgtgggagattatttgaattattaacttcagtccctttacttcttatatgcttttttagatttcctatcagttttggtattttgtgtctttctaagaatttttctatctcctcttggttatctaattgattatctaattcgttggtatatgattattcatagtattcctttattatcctttttatttctttacaatgggcagtgatgtcccttctttcattcatgattttagtaatttgagtcttctcacatttttttctttgtctacctagataaacgtttgtcatttttactgatcttttcttagaacctgcttctttgaatactttctctctccctacctctctccgtttctccctctctcccttcctctccccgcctcctcctctcctctgataatgagagacttagatttctcagatactctttcctggagcaaagcttctgcaatgtggagcagggtgaggggatgagaaatgctggcagtctgccactggggttggggggagaaccttagtcaggaaactggctgtataaggatctgtctgttttgagctatggctggaaggagtggagctgctgtcacgctaagctggggggcaggtgagggagctggttgctgctcgtactgatatttagtacattttttggaataaatgtttctccatttgttgaatactctctgaatttcccgagactttaaattgttgtgttccttagtaatattcaccatttatttcactaggaagagggctcacagagctcttcgtgttgcctttctgtcaattgtctctccagtctggcattctttttgatacccacatgaatcccttccatttaaaatgagcccactttcttgtgccgggtgctctctggacttgtccaggtctctgtaccctcttttcccgtgtgtgtcatggagacatatgctaggagagccacagccttgttctggtcagcttgattcctgttccaatttggttccctttccttctgtctttatctagaccatctgttttttgcttccattcttattgcttctgctgctgccctgtgtattttctaaggtgggatctgccctaccccaaaaggctcccactggcataacttgaaacaacctgaggagagaatgatgtaaggtgcaacttcttgttgttccaagtaaatgcgtataaaagaattccagctactatctgtttaatcattgctgttttaaaaacaatgaacatttattatctagaaagtaagaaatttaaaatctgctaggaaaatgtttgtaacaccttttccttatgaaaaattctccctgttgtcctggggtacacattcacacagcaagtcctgtcccatgggagggcactttggaagcgctgacctgaacacatctgaacgcattctcacccctcaagcccaaccccagcaactgcacagtgaatctcctaacacaccctcctgcctgctctctgggcacattcttgtcatcagatgtttattgaggagctggattgccttacaagacagtgagcatcttgaaagcagggatcccatcttccttacctctgcatgcctagccaggaacaggtccaggatctggcataaagtagggtctctataattgtatactgactatgtgaatgaataggtcaatgaatcgttgcacatttccagaatcataaaacacaaacttcttagccaggctttctgggttgtcctaatctggcccctgcatactgtcctaccaatgttatcatcttgtagtcttcttctcaaaacaaactcttcatttttgcccagcaggccttctctcttatcctccaaagcatcctgcatactctcacctgctcgccttggctgtgctcttgccttctgctctgcttatttgaatgttttcttccattattcacaggcactttactccctggatctttacccagccactctgcttgaactgtccagacctgtcttcatacttggacatctccctggagaagaataagtctatttccacgaggccaggcagagaatctttaaatttaacctggctggtgcatatgtcttcacctatggtataatagtgacagcagtgtcagatgctgagtcctgtggtgcatatcattaaaagatgttcctccagtctgaaagcaattttgggggggaacagatgtcgaaccagccttcaaaattatgcagtctttagtttctgaaattttcctctttctgcttttgaaaaatcagggtaacttttacttctttgaagttccattctttgtgattctgcaaagaaatttctttttcattcaacacatatttaattaccactacaagccaagcagttactgctgttacaaacagtttatatatatatgtatatatatatatttttgagacggagtctctctgtgtcgcctaggctggagtgcagtggtgtgatctcagctcactgcaacttccgcctcccaggttcaagcaattcttcctgcctcagcctccagagtagctggggttacaggtgcccgccaccacgcctggctaatttttgtatttttttttttttttttttagtagagatggtgtttcaacatgttggccaggctggtcttgaactcctgacctcaggtgatccacccgccacggcctcccaaagtgctgggattacaggcgtgagccatggcacccggcccaaacagtgtatttcttaacatatctaaaatcttctcaggccctagaaatgaattgtgtttggacaagggtgcttttattcctttaaaactactaggtgctctcttacttttgcctccttaaacctgagttgcaaacccttctttactctgggggttggtggagtatagcccttcctggactggatgtctccttgaggctctgttctgttttgcaaatgaacacttactcttcttgtgacatgatgcatccttggaatttgaccactgcaaactttctgcatatgaagggtgagctgtcactccatctgggacgtccctgggttctttataagcacactgctattgcaacagttagctgtggcctcaaaatgtcccattttctattgagctgctctgatttaacttttcaggaaagaaaaaccctgtaatctactgcagacagctgagttgggctgatacatgtgttttctcaaaggatacctcttttagctccacaagaagcaaacagctcactccagagtcctagagcattatacaatgccttgatctgggggagccttgaggaaacctttgctggcaatagcaatgacaattgaggtgagacatcaatagtggcagccattcttcacaaatgtacagtgcttcactgctgacaaagtgctacaggatatatcttgtcttatttattacatcagtattgtgtggtaagcaggtgtttggttaatactgagtgtcaacttgattggattgaaggatacaaattattgatcctggatgtgtctgtgagggtgttgccaaaagagattaacatttgagtcagtgggctggggaaggcagatccacacttaatctgatgggcacaatctaatcagctgccagcgaatataatgcaggcagaaaaacatgaaaaggagaaactggcctagcctctcccagcctacatctttctcctgtgctagatgcttccagccctcgaatattggactccaagttcttcagttttgggactcagagtggcgccccttgctcttcaacttgcagacagcctattgtggaaccttgtgatcgtggaagttaatacttaataaactcctgtatatatatgtgtgtgtgtgtgtgtgtgtgtgtgtgtgtgtgtgtgtgtgtgtgtgtatatatatatatatatatatatatatatatatatagagagagagagagagagagagagagagagagagagagagaaccctgactagagaaccctctagtccctctagagaaccctgactaacacagcaggacaagaattagtattgtcatagaaggagactgaggtcccagaaggcaaaaagcttgattaggatcacaaaaccagtaagtagaagagctcaaagaaaaatctagatttcaggcctctgtgccagagctcaaatggggactgtttcctatgatctgtcttctgactgaaatggaactgcaagagccctgaccacctcaggtgcctggctaatgtagtggtaaattcaaatagtttctcttgagttgtctaccttcaagagtaacatttctgcctgtcctccagggtagtcattcacttgttcattcactcactatgtgtatattgagcctttagtatgttccaggcactagaaatccagcagagaacaaagctaaacatggttgctgacttcctagagcttatagcctggtagaggagagatccaatgaacagaaaattacaaaaataatgataaattttgatagttgctatcaaagaagagtatagggttctatgaaacagaataagaagggggacttcatccagtttgggaaggtcagagaagattaaatcatctctgattaaatcatattcaactcctactcttaatggatggagtaggagttaccaaatgttggttgagggtggtggggtagcaaatggaacagcatgagtgaaggccctgggataggaaagaacttggagtattacaggaaaaagacgagacttatgtggctgaagtggcgcaagtgaaggggaagttggagaaaaatgagcctgcagggtgaacagaagccagatcacgaaagctggggaacaaccccttttaagcttgctttgaatgtacttgagtaggacctagactcctgaagaccttatgaatgcctatgaatttattattcagcctcttctcattcatcttagatgctctggggccacctagaggccaaaacacagtgcccagtggggcaattaaggctaagaaaggcagagcgtgttccctactgtggagacagagtgttagagagttgcatggggcattgaccttggctggcagctttctggaagctaaggcacaaagggaaatttactggtttttgtggtggttgttttctggcaacaaaaaaaattaaagcaaaagctgactgatcagcagccaaggccaatgagtcctgaaactcaattaaactgagaagtcttcacttgggacctgcatgagagtgtactatgacttcagcaagtgctgcctcaaatgaatggcaactctgcttctgctcatggcaccatcaagcctgggagaatggactataccctccagaaagagggaggtggaggcatttctgccagttgggaagataacaaggttcagacagtctgttctctgatgtctgagcttaatgcagcagaataaataagcacaacttgatgaggagggagttaatgtattcattagcttgcattgctccactgaaaggtctgaatacatttgtaacagggcggcattgcaggtactttccaattgatgcccttgagaagtgttgataatgtggtacacagttgggaacccaaagcacttgaatagatgagtccaatttcttcatccctgtatgagaaaataatcaccttatttttaccctccagggattgagggcggagcctgttagaggtggtaacttcaaaccctggacaaagtcagctggatgtctgcaaaaatggaaatcttaaggctttgttagaaaatgttctggaattctgagcaaactatcgcaaggacagaaaaccaaacaccgcgtgttctcactcataggtggtaattgaacaatgagaacacttggacacagggcagggaatatcacacattggggcctgtcgtggggtgggaggctgggggagggatagcattaggagaaatacctaatgtaaatgacgagttaatgggtgcagcacaccaacatggcacatgtatacatatgtaacaaacctgcacattgtgcacacgtaccctagaacttaaagtataataataaaaaaaaaagaatttaaaaatggaaaaaaatgctatagcaaataaatctttataatcatccccccaccccccccccaaaaaagaggagttcttcgttggttgggatcccaactgaaaaggcagacatggcttgtagagcattaaaactgatgttacaaaagctaaataccacatggacagagcagcaagtggccaaagatatctctatccaggtggctaaaagcttccccttggcaggatagctaattttgacacagattgtaatctgggagaagcagacatatcagccttgacgatgaatggggctgccttcccaatgtacacctgtatagctctggaacagaatgggtttaggcggcaggtaggcaggaagaggcagacatgtttcaggttggctggcatcaggggttcaaggtacgctcatcgatgtagtagaaaggaaggagcctcaacatcttccttaaagaataatccggttaacagaccattggttaatagattagacactgggccagaggcccaaaatctgggacataactttgtagttgtaagtgcccttcaacctctgagatatgattggtggcgtgaagtttacagaatttgagggtaacaacaagctgaagaaaaatctggagaagagcctgaggaaacagaatcacagtctgtcttaaaaagacattgcctgatactatcctctttttgtatagatgggacctcaaagcccagagagggagcaagggacatactgaagtcacacaaccactgaatggcagagccagggctaaaatgcatctattctgcttcttgggctgccacttgaacataggttcaagtcttccatggataaatacaagtcacttgatcaaagactaaagagaagtctgcgggtaagcatggagaattatttgactaggctccaacaggacagtgtacaaaaaccaggaagagcagtaggcagaagcctggggataccaacatttaaagggaaggccagggaagagatcactaggctgtgcactctgagggcaggcactggctcctacttactattgctacctcaacacttagtatgtaactttgcacctagtaggtcctagaaaaatatttattggatggacatagaggagtccacaaagaaagtagaaaaaaaagacatagaaatgtgaggaaagctaggtgcgttggcttacctttataatcctggcactgtgggagactgaggtgggtggattgcttgagcccaggagtccgagaccagcctgggcaccatggctgaaaccccatctctacaaaaatacaaaaattagccaggcataatagtgcacgcttgtagtcctagctactcagggtggctgaggtgggaggatcacctgagccctggaggttgaggctgcaatgagccgagatcatgccattgcactccagccttggtgatagagtgaggccctgtctcagaaaacaaaaatgtgagacaaaccaggacggtgcagtggcacacaagtcaagagaatagagagcttcaaaaaggaggtagacaacaactgttaaatgcaacagaggggccaaaataaaagaatgtgttacatgttgatggaatgcttccaattcaatgggctcctaaatcttcatcgctaatgcagacattttccttctgagcaccaagcttggatatctgagtcactgctggccatctttaccttgacatccacgcacgatatcctatgtccccaaatgaacatattatctttctcccaaacctggccctactcttctcttctctattttagtaaatgacaatactgactctggttaacaacttagaaacctaagagtaattctagactagtcccactttctcagccacacaatcaacctcacactgttttttctacttccgtatcgctctcaaatctgtccactctgatcaactttctctgttataaccctacatctctcatgggaaattggaataacctactaactggtttactcaatccacttttgctcccctacagacttttatccaaaattagccaagcagatttcttttcatttataattgtttttgagacagagagtctcactatgttgcccaggctatttttgaactgggctcaagtgatcctcctgccttggcctcccaaatagctgggattacaggcatgtgccaccatgcctaattcatttgcaagtttttattaaaatttattttccacttacattcagaaaaattcactcttctggtgtccagtttgatgagttttaacaatgtacagagttatacaaccactaccacaattgagacacagaacagttccatcactaccccaaaaaccttctctcaggctacctctttgtaatgaaaactcctccccacgcatataatcccttgcaaccactgatctattcttcatccctactggtttgccatttctaggatgtcataggaatgaaatcacagaatatgtagccttttcagatgggcttctttcactcaggatgatgcagtcgcgattcattcatgttgttgtgtgtatcaagagtttgttctttttgttactgagaagtattccattggatggataggtcacagtttgcatttctaaattaagggatgtttgggttgtttccagtttttattggacaattatgaataaagctactataaacattgactacaagtttttgtatgaacatgtgttttcatttcacttgggtgaatacctaggaataggactgctgcatcacatgagaagtgtatatttaactttattaaaaatactgccaaaatgtcttacaaaatgacagtaccatttggcgttcccaccagcactggatgagggttccagtagctccacagcctcaccagcacttggtttgtcagttctttcctcttttctttactttttaatgttctaatagatgtgtagtagtgtctcattatggtttcaaagtgcatttccaaaacaactaatgatgccaagtattttttcatgtgcttatttgtcttatgtatatatattctgtatatcctctttggtccatcatgtatcttctttggtgaagtatctgttcaaatattttatccattttcttaattggattgtttgatcttgttgttgagttttgagattgccttgtgtattctaaatacagttcctttttcaaatatctgattacaaataatttctcccagtctatagcttatacttttattcttttaatagtattttttgcaaaggaaatgtttttaatttatataaagctgatatatatttttcttttatggatcatgcttttggcatatctaaaacctttttgcctaaccaaaggccaaatggatttttcccctatgttttaatttagaattttatgattttatgcttttcatttatgtctatgatccattttgagctaacttgtgatgagatttgaggtataagtcaaagttctttttttgcatatggatgtctgattgtttaagtactatttgttgaaaaaactatttccccattgaattgccattgaagttttgtcaaaaatcaattattcgtatgtgtgtgggtctatttataggttccctatttttttttcctgttgatctatgggtcagttcctccaccaacatcacactggtttgtttactttagctttatattaagtcttacaagcaggtagtatgacttttccaactttgttcttcttttccaaaatttcatttttattctatttcctatgtctttctatatgaatcataaaatcaatgtgttgataactacaaaaaaaaaacctgtgattttgttggggctgtatccatagatcagtttgcagataattgacattttaatgatagtgagtcttccaattcataactagagtatgtatttccattttttaggtctttaagtattagaaatagtcaaacccatagaagcagagaatagaatgatggttgccaagggctggaaggaggaggaaaaggggtattgctgctcagtaggtataaagtttcaattatgcagatgaataagttctagagatttgtcgcgcagcatagtgccttttgtgcactttacaatttttaagaggatagatctcatgttagataattttaccacattaattaaaaagacacagtggaacacaaggaaacttttggaggtgataaatatgtttattacctcgattgtggttatggtttcatgggtttatgcatgtattcaaactcatcaaattgtatacattaaacgtgcagtttttgtatatcaattgtactttagtaaagctaataaaaatgtaaattttcaaatatgaattgccgatatatagaaatacaattaatttctatatgaagaccttttacactgtgaccttgcactgtgactctcaaactgagtacgcgtaagatttcattggatatattttagattttgttggaattttttactttgatagtgatgctgtctcctgatagagacagttttagttcttcttttccaatgtgtatgcattttctttcttttcccttattgcacttgctatgatttcaagtatgatattgcataggagtggtgaaagcagacatctttaccttgttctctatctagaggaaaagcattcagtctttcatcattaggtatgatactagctttaggatttttatagatgctctttatcaggatgtaggaattactttttattcctggtttgcatagttttttttaaatcataaatggttattggattttggcaaatactttttctgcatcgactgatatgactgggtgatttttttctttagtatgctatattggctgacttttgaatgttgaagcagccttgtatttccaggataaacctcacttggtcatgatgcattatccttttaatatattgttgaatttaatttgctagtattttggtgagaacttttacatttatgttcatgaggaatactggtctgtagtttttctttattgtaatgactgtctaattttggtaattaggttagtactgatgataaaatgagtttggaagaatttccacctcttctattttctgaagaatttgtgtgatggagtattatttctcctttaaatgtttgggagaatttgctaatgagatcatctggacttgaagttttattttgtggaaggttttaaactatgaattcaatttctttaatataaatatgactttttaggttgcctctttcttcttaagtgatttctctaagtttgtatctttcagagaatttgtttgttttatctaagctgttatatttatgagcatcgagttgtccatgttattccttaatcatccctttaatgtctatagcatctatagtgatagcctccctttcattcaagacatcagtaatttgtgtcttctctccattggtctggccaggggtttgtcaatttcaccgatttttttttaataaagaaatggctttttggccagatgtggtaatgcatgcatgcaatcccagcattttggaaactgaggtgagaggacagcttaacaccaggagtttggggacagcctgggtaacatatgccatctgtacacatctttttttaaaaaattagctgggcatggtggcatgcacctgtagtcctagctactcaggaggctgaggaaggaggattgcttgagcccaggagttcaaggctgcagtgaatcatgatcaaaccactgtactccagcctgggtgacagagtgagaacctgtcactaaaaaagaaaggaagaaagagttttttgtttcagtgatttttttccctaataattttgttttcaatttcattgatttctgctctttagtatttccttactttggcattctgtttgctttggatttactttttatagttgtagtttcacaagatagaaatttatatcactgatttcagatttcccttttttttcccacataagcattacatattattaaattctccccaaagcaccaggggcaagctacttctgttgccctgccctgagtagccaactattctatcaaaaattttcttgacaacaaagtgggctaatcagtgttgggtctgtagcctccaaacaccattatttcagtcctttggggtgttgtcatcagcttttagtagaatgagatttttggaccctctgaaggccctttagttgtttccagcatagggcaggatgcaagaaacgccactatgaggtaggtggcttagaggtgatatatttgtctccctttttagagagttgatactatcatcctacatatatcacaccatctaggttctggcaatttataagctgatattgctcacctacccctaccccctgcaaatacatgcgaaaacaccaggccttttactttcttactagtgagatagtgataaggaggaaatttgtcttcagtgctcagtgctaacctagtccttatccctccatgtctggttaactgtggacctgtccttctggccccaaccccgcaacacccacctccctccctgtccacacaccacctcttccctccttcctccctccccaccatcctagaacatgaagacactcacatcattttacaacagattcattttattttcatcaccatggggcgtaccctgtggggtatagaatgtatcctagaccctgctagctagttctttggggtcagatctctggagacctctcagatagatctaggcctctgaacttgccttgaaattactggctgtccagggagacgctggagattgtggaggtctcctggctaactcggtcctgctatggctcattttgagtgagtttcctattcagctggtcatagtggctggatagtgttggcccgttcccttcctcaggttttcttgaagtggtagtctttttgggagtggtttttttcctggaactttctcgaagggtcccttttcccttccaggttgtctttggaacttggaaggacaacagggagatcacagaagggcactggttttggggaagaggatgggggaggggtgggaatgggggtttcatcaataaagggtgcaggctggggtagggattgtgccaggcgaggacagggtaaggcgtcttgggagggaagagtcaaggggtagatgaggaggagcctgggtgggtcactcaccttcagagggcttctggactttggttgagagggggccctgcctcttccttacccttttgttttgttttgttttgttttgttttgttttgtccttctgaagaaatagaacttaccttaaaggaaaacactcatagaattatttttcatgaatagttctaacaagcttccagcttcttggaggagacactttgtgatcaatttcagtccctccctgggtagaggcgtctcattcaggtttttgtccctggaagaaaggaacgatagagttagccacaggccagagtggctgtattaatatcatacaaagtagatttcagaggaaaaaacatcatcaagaacaaataagtcatttcataataaagttgtcaatcaagagaacaaaatattctaaacttttatgcccccaacaagagagcttcaaaatatatgaaataaacaatgataggaccacaaggagaagtagacaagtccataatcatagtcagaggtttcaatacccttctctcaataagtgaaaaaacaagtagacagaaaattagtaaagacatagaaaatttgaactacactagccattaaattgacctaatttacatttacagaataatcccagtaacatcagaatttgcactattttcaaatgcatatgagatatttatcaagatacataatattgtgggttgtaagtcaaatctcaatacatttaaagtctaagtcatgcaaagtttgttctctgaccacaataaaattaaatttgaaatcaataagggaaacatatctggaaaaaaaacccaaatatttggagaactaagtaatatactcctaagtaacttatggggcaaagaagaaaccaaagcaaaatgatcatatattttaaccagtatgaaaatgagaacataacgtaacaattatgtgatgacaccaaagcagtacttataaggaaacttatgttactaaatgcctgtatttgaaaagaaatgtctcaaatcaacagccttagcttttcctttaagaacctaggaaaagaagagcccaggaaacccaaggaaagtacaaaaagggaaataaagatcacagcaacatcaatgaaatagaaaaacagtagggacaatcaatgaaaccaaaaggggattctttaggaagaacaataaaattgataaacttctaacaagagagatgagaaaaaaagataaaaaatacaaattaaccaatagcagaaatcagaatggtgatatcactacagattctacagataatcaaattataagaaaataatatgaacaatgtacaacaataaatttgacaacttataggaaatagacaaactcctgaaagacacaaactaccaaagctcactcaagaagaaatatataacccaaataaccctataaccattaatgaaattgaacttgcagtttaaaatattctcagaaaggaaatttcaaggccagatggcttcactcctcaattctaccaaatgtttaaggaagaattgacagcaatccttcagaaactcttcaataaataaataaataaataaataaataaataaataaatgaaggaacacttcccaaagttattctttgagggtactattaccctgaaaccaaaataaaagacatcacaggagagaaaaactgcagaccaatagcccttatgaataaatgctcagatattctcaacaaaatactagcaaactaaatccagcaaactgtaaaaagtattataccccgtgatcaagtgcaatttatctcagaaatgcaagatttgtttaatatccaaaaatcaattaatgtaatacccccatattaattgattaaagggaaatatatatataatcacctcaatgacaaaattcagatcttttcatgatgcactcaacaaatcaggaatagaaaggaagtgttcctcaacctgatgatggcaaggtacaaaacactacagctaacatcatacttaaaggggaaagactgaaagctttctccttaagattgggaataagacaagaatgtctgctttcaccacttctattcaacaggattattaggaaagaaacaaatgaaaggcttccaaattggaaaaaaataagtaaaattgcctttatttgcagatgacacactactaaaactagtaaatttagcaatgttgcagagtacaaaatcaatatacaaaaatcaattttatttctattggtatcaatgaccaatcaagtggtgaaattaaaaattcacaatagcatctaaaatgatatactagacaaaagtttaacaatatagtgaaggatctatgcactgaaaagtataaaatgttgctgacataaagaaaggttaaataaatggagatatcgccctcattcataggtcagaagactcaatattgttaagatgccaagtcttcttaacttggtctacagattcaacaccatctcaatcattatcccatcagtgtttttgtaaaaattggcaatatgatcctaaaattcaaatgaaaatacaaaagaccagaacaactttagaaaaaaataaatttacaggatgaacagggcctcatttgaggttattataaagctacaacagtcaaagcaatgcggtaccagcataaaggtcagtggaaccgaatggagagtacagaaatacactgatgcatactgtgatggttaattgtatgtgtcagcttgactgtggtaaggaatgtccagatagctggtaaaacattatttctgcatgtgtctgtgagggtgtttccaggagagattagcatttgaatcagtagactgagtaaagaagatctaccgtcaccaatgtgggtgggcatcatccaatcttttgagggcctgaatagaacaaaagatagagaaaaggagaatttgctctttctgcttgagttgggccattcgtcttctcttgtccttggatattagtactcctggttcttggaccttcagatttgaactgagacttacaccattgaccccccatccccggttctcaggcctttggactcagactgggacttacatcatgggctcccctgattctcaggcctttgggcttgagctagaattgcaccactggccctcctgagcctccagcttgcagttggcagagcatgggactgctcagcctgcatgactgtatgagccaatccctcataataaatatctttatatctatatcctactggttctgctcctatggggaaccctaactgatacacatatatagacaaatgaattttttaaaaagtgcaaagaaaattcagtagagcaagaggtactttcaacaaatggtactagaaaactcagatatagatacgcaaaaaatcccccaaacctcttattacccatacctcacattacatacaaatattaaagagatcacagacctaaatgtaaaacctaaaaatataaaacttctagaagaaactaaaggagaaaaccactgggacctcagtttagacaaagatttgttagatgtgacatcaaaacccaattcataactgggcttcatctaagttaaaaacatttactctttgaaagacactgttaaaggaattaaaggacaagcagcagataggaagaaaaccatatataggaagaaaaccgtatatatggtagagacattgtatctaaacatattgaagagccctgaaaactcaataacaaaaaccaaacagcccaatttttaaaaacttgggcaaaagatttgaacagacacttcaccgaggaagatatacgaatggttaataagcacatgaagagatgcccaagaccattggggaaatgtcaactaaaaccaaaatgacataaactacaccgtcattagaatggctaaaattaaaaagactgatcacatcatatgcttacacggatgtagaggaagtgaagctctcacacccaattgatgggcccgtaaaatggcacaggcacattggaaaaatttggtagtttctcagagttaaagacatacatctatgatatgatttacccattccactcctaagtatttatcaaagagaaatgaaagcacgtgttcacacaagggcttgtatacaaatgtttataacagctttatgtgtaatagtccaaaactaaaacatttacagatgtccattaacagatgaatggataaataaattgtggtatggtcatacaaacagcatacaatactactccacaataaaaaagcaataaaaaggaacacattattgatatgttccacatgaattaatctcaaaataattatgctgagtgaaagaaaccagaccaaaaattgtacacactgtatgattttatttacataatagtctagaaaatgcaaactaatcgatagcgacagaaagcaggtagtgtttacctgggaactgggggtgggaaggagaaggagtgaaggatgaccaagaggaacaaggaaaatttgaggagaaggatgtgttcactatctttattgtgatgatggtttcccggatgtataaatgtgtcaaaaattatcaaactgtacactttaaacatgtgcagtttactgtatgtcaattatacctcaacaaagctattaataataataatgaatataataataaattataatctttggtcagaccagatccttccttctaagtttagccctaaccaaggtccactggggtaaatgggctactggtcaggctgataatgaccagaggaaaactcttccctttactgagtgcttactttgtccctggcttagtgctgggtgctttcataggcattatcttatttaaggttcatagcaaatgtatgtggaaagaaaaagggtcagtgacttacctaaggtcgaatagcttttaaaaagtgaagagctctttaccattctgcaaaggccttcacttctagtcaatgccaacaatgcagtcagtgtataaaaagcaaagccggccaggcgcagtggctcacacctgtaatcccagcactttgggaggccgaggtgggtgaatcacctgaggcaggagtttgagaccagcctcgccaacatggtgaaaccccgtctctactaaaaatacaaaaattagccgggtgcggtggcgggcacctgtaatcccagctactcaggaggctgaggcaagagaattgcttgaacacaggaggcggaggctgcagtgagccaagatcacaccactgcactccagcctgggtgacaagggcgaaactgtccaaaaaaaaaaaaaaaaaaaaaaagcacagccttctcatatgccaagacttgcttggcagggcctagagcagaaaatttaattaagggcctggttttggacatgattttcaatattgttcacttcataacaacactggaaaaattaagctacttttgttttagtcattttgagaatcttaccaattacaccgacatgcacaaacagctgatgtaaagctatttgagttctcaaatagctacagaatttttttcaccagtgcctaatgaatcttcctaaaaatacttctttcctctaaatcctgacccagttccctactgttcacaaaagaaatccccaaaccgaacattcatggaaaacccaagctatgaagttagagttatttcttactagtaccttctacttggtgaacacattatagttttctaaaatcttccttataattatctttttataattctcacaaaagaacaagaattagaatccccatttagccactaattaaataagactgacagtaaaaagtgttgtaaggacgtgaagaattgcaaccctcacacactgagtgtgggaatgtaaaatgttgcagttgctttggaaaacagtttggcagttccccaaaaacttaaacatagaattaccaaatgacccagcaatgtccacacaaaaacgtgtacctgaatgttaatagcagcattattcataattgccaaaagatggaaataacccaaatacccatcaattggtaaacagataaacaaaatgtagtatatccataacatggaatactacttggccgtaaaaaggaatgacataatatatattacaacctaaaaacactttgctaagtgaaagaagccaggcacacagggtcacatatcgtataattccatttctatgaaaagtccagaataggcaaattcacagaggcagaaagcagattagtgattgccaggagctgcagggatgggagtgggaatgaggagtgactgccaatggatacagatttccttttggattgatgaaaatattctaaaattgattgtggggatggttgcccaactgttaatatactgtcaacgctgaatcatatacttcaaaagggtgggttttgtgatatgtgaattataactcaatttttaaaaaagaatcctcatttagcagatgaaaaaactgagaacaggagaggttaactgtcctgcctagatttcctgcctctagctttgtcaactattctgaaacccaaaatgtttggagaggacttaggttaaattctccttttctatccgggctgtttcttgtctgtcccagagctcaccatgctaattcttgagcacagactgtgctcagcactgtatcaggaactcgagatgtatgactccacacctcctccctatgagataggactatagtttttcttctgtcattttaaataaaagaatctgagactcaaagaacttaagagactcacccaaggttacacaatagtaagaggtaaggaggctagagttgagtctccgctcttccacttccccgcccccaacacatatttttatcccactcatcagaacaccttttacctctcttacacatatccacagcagactcacctttccacgagactcacttgtttctcaactgtaactggaggaacagactccaatggcatggtggagacactgggtaatcagatgtacagtctgatccctcagcaccagtgggggattggttccaggattcccatagataccaaaatctggggatgctcaagtacctaatacaaaacggcatagtatttgcacataacctatgcacatccttctgtatactatttatttatttattgagacaaagtctcactctgtcgcccagtctggagtgtactggcactatctcagctcactgtaacctccgcctcccaggttcaagtgattctcctgcctcagccaccttagtagctgagattataagtgtgcaccaccacacccagctaatttttgtatttttagtagcgacaggtttcgccatgttggccagggtggtcttgaactcctggcctcaaatgatccgcccgcctgggcctcccaaagtgctgggattacaggcatgaggcactgcctcagcccctcctgtatattttaaatcaagaatgtccaacctgtggcccaggatggctttgaatacagcccaacaaaaattcataaactttcttaaaacattgagggttttttttgtgatttttatttttacctcaacagctataattagtgttagtgtattttatgtgtggcccaagacaattcttcttccaaagtggcccagggaagccaaaagattggacatccctgctttaaatcatctgtacattatttataatacctaatacaatgtaaagctatgtaaataattgatatattttattatttttaaatatgtcaactttttacttttttgagacagggtctcactctgttgccctggctggagtgcagtggtgtaatcacagaccttctaggcttaagggatcctcccacctcagcctcctgagtaactgggaccacaggcatgcaccattatactcagctactttattattattattattattattattattattattattttgtagagacagggtctccctatattgcccaggctaattgcgaactcctgaggtcctcctgccttggcatcctaaagtgctgggattacaggcatgatccatttttattgttgtattgttattttttgtttttaaaaataaccaatccatagttgattgaattcatagatgatacagagagcccactgtactgatttttctaaaaatcagcctgatatattttaacatttccagttcctatgttgaaacaaaagggagaaaacactgttttccttacattggatgcacttcagaaatgaccgttcccaaaacatactgtttccctgaagaacaaacttgctgtcccatttaaaggacagccctggctatccagctgtttaagctgagaaacttgggcatgtatagaagccatgaccctatggagagttggatgcagggaaggtacagtttttcaaaggcctcccagcagagttcaaggtgtggttagggccaaagtccagtgcataggcccctggtgcaagtgtgcagggcgaagccttttctgatccccatatgtggaagtcacccctcactcctttgaatcccgttccctgcctccccaaatgagacagacttctactatcatatatgggatgattctgagtattttcccacatagtcacccttctcgccaaccagacataaggttctggagggcagagcccatgccttgctgtggcatggcatgtactgtggcagacacaattcccagcacacagtaggtctttatcacatgtgtgaatgctcactggattttagactaaataaaagagaaaccagatatttttagccttggaagaaaaatcttatcactttataatactcaattgaactttgcagagtttcccttttattctgaaaatacatgaatatatttcccaaacttaattctgagacatgttgcagcaatatttcatgaaagttaagggaagccatggtattggaacaagggaggggaaatgaggaactttgctctgacctctcctttcaaggggtgactgcttaaaatgggagatgggtggcagcagagagccactgcatatgactaatgagcacgtgggagtctggggagctagtggggcattttgcctctgacatctgaaggttggcacaaaaaggcacaggccaatgggaaattggtgtgagggcattagggtgggcggaggcaggctctcagccactttgccccaggacagggttagggttggagacactaaaatgcaaggcaagttatgaagacaaaggcaagtcctgcaggatgaagatgagaccagaagccaaactaactagcagcagaacacgctaagagcctgacctgaggtcgctccaattttcctaagtaacagggtgagtcccagtatctgggaaccagtgacttcaactaggaggagaggaagactgtccttcaggaagaacagaactcagcactgtcactgaggcccctgagtcttcacccagagtcatcttgattgtgcatttaatcatcatgacaaccctggaattgagatgttatcatccttcttttactgaagctcagacaagtagaggagcctgtccatgattcagcccaaggtctgtctgactgcaaagccaaggcccattggttcctctatatctcataagtagaggctatcatgtgtcagagatgtggaaggaagatagagactcacatggaaggttgctgtagataacctacaaggtaatcaatctaaaccaaagagtttttgagtctttaaaaaggcagagaagatcacttgatggaggtgctcaaatcccagggatggtgggagctagaaatcaaagtgctatacctggggttcttggagcctgcctcctttttaaggctaatatggcagcacaccatagacaacacagagtgcgcctggtaccttgctagtaatacaagtatttgttgaattcgatgaaagaaagtaatagcacctggagaggatgtggagcaataggaacactttaacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaatgtggcccatatacaccagggaatactatgcagccataaaaaaggatgagttcatgtcctttgtagggacatggatgaagctggaaaccatcattctgagcaaactatcacaaggacaaaaaaccaaacaccgcatgttctcactcataggtgggaattgaacaatgagaacacttggacactgggtggggaacatcacacaccagggtctgttgtggggtggggggtgcggggagggatagcattaggagatatacctaatgtaaatgacgagttaatgggtgcagcacaccaacatggtgcatgtatacatatgtaacaaacctgcatgttgtgcacatgtaccctagaacttaaagtataataaaaaataaataaataaaaataaagtaatagcaccaatagtaatatcactttgcattcatattgttcaaagcaaaaataaatatcaagttggtttgagcctcagaccatatcaagacatacagaaggaaaggaatttaatttttaaagtaggttataaagttcaaaacagaacaaagctcaagtgagtttccgacataaaaatagataacattttagattttgttccataaaagaataatcagatcaatacttcagtaagcagtttcagctgtactgacaaaaaataaccaacacggatttctgaagtggctagcgtaaatggactgtcatctctcttattgtgtttgtatcaggtaccaactttccttatcatgaaagtttttaagatggagaaggtggaatatattccctcattttctcagtaattttattgatagttcttgaaagaatagcattgattaaaagaaaagatattagaggggaaggacagttataaatctaaactgtggatttgtaattccaaagaaaatgttcatttttcatcaccaaagtcaacataattccaggaaataaaatgtcattgcttatttttgtactcaaaattgctaatattacaggccaaccttgacaactttgtagcaacttgacaactttaaaacctgagcagtaacccaggttttaaaaagaaaatcatttcacctttacctcccctcttgaagcagatgagaatctcactaagatcctgtaaatgtaataatgttagtgcttaagagatagatggagaagcatgtctttgaacagcagggctaactcatcaggcatgagatttctgtttccataagttattcacttacagtgagattcccaactcaacactcaaccccacaaaggaaactgtctctggttagccaatcaacacaaagcatcaaaatgggcccttcaaattgaataaacctcacttcaataaggcccaggtacgtgaaatcaaaccatctggatgaaaggtaagtaatttcttctgacatctggatgacttgtctatgtgccaaaactagatgttgttccaaatctcggtgaccaggccatgctcgctgggtaccaagacatgagggcatcatatatcgtgtcaaggcccacaaaaatagatctctgctgatgttagtggcgtattcaccagattctgagtgctggcaatccaatttccaagcatgctttgatgcctgcatcttcttgattcctcactgccacaacgtggtagaggcatgcattaaacagtgaattcaaggcacaggtggagaatgagaaagttaaggcatgctgctttaatacaatactttcaaagatgtttctccgtagtaacaaatgcaactgaggaaattgagaaaagtccaacattttcttgtttggctttaatactgactagtcgcaattgatgcgaaagttaatgtatccagagagaggaaatgccagagacattttaaaagtattgatgccgtgtcagtctttaagtttttagtattcttaaaaactataggatgtggttgagaacaaccgaaatactggataataacatgaaacagtgggagaggccaggcgcgatggctcacacctgtaatcccagcacttcaggaggccgaggcgggcggatcacaaggtcaggagttcgagaccagcctggccaatatggtgaaaccccgtctctactaaaaatataaaaattagctgggcgtgatggcgcgggcctgtagtcccagctactcgggaagctgaggcagaagaattgcttgaacccaggaggcggagcttgcaatgagccgagatcgcgccactgcactccggcctgggcaacagatcaagactctgtctcaaaaaaacaaaaaacaaacaaacaaacaaaaaaacagtgggagaactgcaacttaactatctttacttcattgcccaaggtctgctgaaagaaaataaaaacataaatcaattatctctggatgtaaaaaccaagacctaggaaggagaagagacttgctcaagtcagtagcagggctggaactggaacccagaccttcctgggtgctaactcagacctttgtaatccatgctgcatccctaagtcagcaaggagcaagccctcttaataaggttgcattaattctagtgcatatctcataaaaatttatagagctatcaatgtctgcaataaaaagctcagctagatttccatttaatgaaaatattaaacacaccgtttcagagaacattgtttatttgcaatatctcttcctgttaagcttgatttagtgtttaagcagagaaatctaatctcatataaatctcaacagtaaataattcaggtttcaaatcagataaggtatgaattcaacttccagatttgtgttcctttctctaattgacaatgcaagcttttgctgccatttatacagggaattgtgtgtcttacctgtaatcaaatgaactctttgagttaaatactgatcagttgccttctgctttgaagttttctttaaacaatcaggatccacaagtttcttgaattcaggcagacattcatgcttgtttgctgatgctttttttttcctatgtggaaatggaattaatctatagagttttgaagtcttaattatgactgagctttatatattaaacttctaaacacttcaaaacaatattagatatttggatgccacatggcacacattccaaacctgtctaatttcccacgggctaatgcagaaagtagaatttcagtcatttgctcatcctgaattctggctttccacgtcagcaaacattttctgattggccattctgagcaggtagacccagagatgagatgtggagttgaaggtggaggacggggaggtgtggatatgaatagacatgactaagaccttgtctttttcctcacatcacttatggtccagatggaacattaagacagaaacatatgtatcactcaggaagggcagtgaagggagtgtttctgggcaaagtcttggggtgacttcttagaagagaagggttggaaacttgtccttaaagaataggaaaatttcaacaggcattactaggaaggttgggagtgagggagtattgcaggtagagggaacagcaacagcaatggtacagaggtgggaaagggcagatgacactggggactgaatggaaacaagcccataaactttcattgactgtgtttggtagggctcacgtatgcagcaaaaccatatggctggctaattagagacatgaatttcagtgctcttgtgccattaagataagctacaggcaactctggagtctaaggctgatttcttctactgtaatccatctaatgatgatggattagggactattgtctagctaggccccactgaaagtttctaaagtttctgtcaaagccaataatgagaactgggagccacaaggacctgggacaaatgtagagccttcctctgtgcctgataaggtgccataattcttttgtttgcttggaactttgtaaattcaagagagagcaggagagcagaggccaaagcaggctgcttcctttcaacgggccccataggacatctgagggaattttcaaggtgaagcctctaaaataacagggactaatttcagcatgtgcaaagatagaatctggaggtctgaggctggaagctgtaattctctaaagctgctatctaaacaaaagcccacagaggcaaactggagcaaactgtttagaaaagtcaagaaaagtctgtttggctaaatttgtacaataggcacattcaaaaatccttccagaattttccattttccattgggccacagctcaaagctgccctctgttacacatagaacagaggtgcagaccctatgagaaagaaaggaataacccaagaaacatttatcaggacttcaagtatacctatactgccaaacgctttgtgtgactgctttaatccacattctatttcctcaccaaaaccatcagagtctgggataattttacattgcacatttaacagtggtggccaggattggtgaccactttgaagtattagcgcttggaattgaaatacagggtttttgctgctgtgtaagacacctaggaacagaaacccaatgcaaaaaaggcaattggtctttcctactacaaacactgcctcatgttcattgacttcatttatgttcatttaactccagcaacctgaagaataggctatataatatttcaactcagaagtataatttacctatgataaaattcatcctttttagtgtatagtcccgatatctgatgaatacatagttgtgtaactaccattacgatcaagatatggaacagttcaagcagtcctaaaaatactctcgtgcctctttgtagtcaaatccttccagtattcccaccctttgacaattattggtctgttttctgtccccttagtttttcttcttgcagaatgctatgtatattaaactatgcagtatgtagccatttgtatctggcttctttcacatagcataatgcatttgagaatcatcagtgtggttgggtatatcagtagttcattcctttatagtttggtagagcattccattgtatgaaagtaccacaatgtgtttatcctttcatctgttgaagactacttgtgttggttctagttttgaaaattatatacaaagactttacaaacattcacatatagagttttgtgtgaacataagttttaagttctctttagcaaatacctaggagtgggattgctgggttgtatagatactacagattgaactatacaagaaactgccaaaatgtatttcaaagtggtggtaccatttgcattcccaccagcaatctatgagatttcccgttgctctgcttccttttcaagatgtagaattacagtttattaactactagtataggtgtgtatcttgttgtggctttaatttgcaattccctaatgagtaatgatgctgagcacatcacttcatgtgctaatttgccatccaaatatcttctttgatgaagtgtctctgcaaatatttttgaatattttattggcgtatttgttttcttattattcggctttgagagttttaaaaaatatattatgattacaaatcctttatcaggaaagtgtcttgaaatattttctccaagtccatagtttgtcttttcattctcttaatagtgtgtttcatagagttttaaattttgatgaggtctaatgtatcaattttttttctgtaaaagtattatgattttggtgtcatatataagacatttttgcctaactcagggttacaaagactttagcttaggttctgcattagtctgttttcatgctgctgataaagacacatccgagactgggcagtttacaaaggcaagaggtttaacggagaagtcacagttccacatggccggggaagcctcactatcatggcggaaggtaaaaggcaggtcccacatggcagcagacaagagaagagagcttggcaggaaaactaccccttataataaccatcagatctcgtgagacttaatcactatcacaaaaacagcatgggaaagacctgcccctgtgatttaattacctcccatctggtccctcccacaacatgtgggaattcaagatgaattgggtggggacacagccaaaccatatcaggttctcttctagaaatttctttcttatagctgttacatttaggtctataatccattttgtcttattttttgtatatgttttgaggttgaagtgaatatttatgtacatgaatattcagtggtttcagcaccaagtgttaaatacactatgattttccattacattatctttgaaccatttttgaaaatgaatggttatatgtgtgtccattagtgactatatcttgttccactgatcaatgctatcttttaccaatgctatatcgtcttgattattgcagctttattgtaagtcttaaagccagttagtgtgattctaccaaattagttctttctcaaaaaatgtgtgactgttctagagtctttgccttttcatatacattttagtatcagtttggttattccttttttttaaaaaaagacaaaatccttctgagatttttatcgggattgtgttgaatctatatataaattgaggtagaattaacatcttaacaatattgagtcttccaattcatgaacaaagcatgtgtcttcatttacttagatgttttatttatttctcaatattttatagtttttaccatattttgtaagatttatatataaatatttcctgtgtttttgagtgctgttataaatcatactatttttgttaacttgttttcaatcattcattgctagtttatacatatgcaattcattttgtatattgaccttttatcttacaactttgttaaatttgttctagttttttttaacttttattttaagttcaggggtactagtgcaggtttgttatataggtaaacttgtgtcacagggactcgttacatagattatttcctcactaaggtattaagcctagtacccattagttatttttcctgatcctctccctcttcctaacctccaccctccaaaacaccccagtgtgtgttcttcccctctatgggtccatgtgttctcatcatttaactcccacttataagtgagaacatgcggtatttggttttctgttcctgtgttagtttgctaaggataatggcctccagctccatccatgtccctgaaaaggaaatgatctcattcttcttatggctgcatagtattccatggtgtatatgtaccacattttctttatctggtctatcgctggtaggcatttaggttgattccatgtttttgctattgtgaacagtgctgcagtgaacttacatgtgcatgtgcctttataatagaatgatttatattcctttgggtatatacccagttagaatgatttatattcctttgggtatatacccagtaatgggatagctgggtctaatggtacaatgagataccatctaacaccagtcagaatggctactgttacaaagtcaaaaaattacatgctggctaggttacagagaaaaaggaatgcttatacgctgttggtgggagtgtaaattagttcagccattgtggaagacagtgtggcgattcctcaaagacctaaagacagaaataccatttgatctagtaggttttttaatagattttttaagggctctctgtgtagataatgatgtcatctgtgaatagtgacagtttttcttctttccaatatgaaaatgcctttaataaatataggactgttcagtttatcttcatcttcttatcttttggtgccccaggaaaaagtctttgaacctcttctctactttcactacatttgtaatctcatcctgtctcatgggtttaaatactacctacccactactaattctcaatcacctctagccaagatttattttccattctccgacttatctaactgctaacttgatatcgccatttggagatcaagtagatgtctcaaactaaacaagtctacaactaatttattaaccttttgctctgatctgccttacccatggccttccctttctcattggatgcaattctattcttccagttggttaggccaaaaacattggcatcaaacttgtcacctctctcacatgacaacaatctgtcagcaaatcctgatggttctactttcagaatatatccagaatcttaccacttttcaccaactccagtgctaccaccctggtccaagccaccttcatctcttaccacccagactactgcattcacgttctaaagggtctcgctgcttcagcccttgacccctatagtatattctcaatgctgcagccaaatacatcattttaacatgttaaatcagatcatgtcactcctttgcttctgatttcactcaaaggaaaaggcctaaatccttcaaatgtcctgtaaagccttatattatcttatcccttttccagttacctgtctaatcctcttctaccactttaccttgatttctctgttctagccacactggtatccttgctgttcctcaaacatgcaagtctcactcttgcctcaggacctttgcattgatgttgccctcttccccgagaatttcctaagggtaactccctcaagtctttaaatgtcactttctcaataggacctatcctgaccatcctatttaatatagcatcctgtcccaacttcatcatatccccctcaccacatacattgtactctcaatttactttgccctgttctactttttcatttttataaacactatggccttctaacatattatcataaaattaatatatgattcaggttttggggtttgagggggcttttttttgagacagggtctcactctgtcactgaggctgaagtgcagtggcactatcatagaatactgcagccttgaacagtcctaacctcaggtgatcttcctaccttagcctcctgagtagctgggactacaggcatgcacaaccacacctggctaatttttctgtatattttgcagggatgagatttcaccatgttgcccgatctggtctcaaactcctgaacttaagtgatctgcccaccttgacctcccaaagtgctgggattacaggcatgaactgccacacctggccaggatcaggtttgatatctgttttttcttgttagactataagtttcactgctatatttctattattcactgatatatctcactgtatttgctttattcactgatatatctcaattacctagaatactacctgggacaaaataggtactcaacaaatacttgctgaataattgaatgaactcctgcaagaacaatcctttgtgtgaaacttcctaatgccagattcccagatggtctttataaaggctcttatgagctgtggcaggctgagtgccatggaaggaggaactgtgcaatttggagagttgggaaaaatcaccgccacaaatctgctgcaaagcctgtaagagaatatcagaaaggtctctgagtcacagtggcaggcccagggacatttggctgatttacatcaaggtctagccccgctgctgccaacagtggctctgtttaataccagtgacgtatctgtgctgcaacatcaaatgtgttccaaatcgtaattgtaaaataagaaaactgctcagcatatgcagagcctccaagaggggggaaagaaataccatactgagcaagcccagaacttgaaaataaccacccctatcaaaaaaaaaaaaaaaaaaaaaaaaaaaaaaaaaaagtctatttgggttgggctagttctgctggtatcttagttgaaatgggaagaaaaaaaaaaaaaaaagaggggctttgtaccacactgaataaactctcctgaccatctgtctgttaattcaaaagcatccttctcaagaattggctcatgttgttggtgctgttttctggtgagtattgggacttctgtgtgtgtgtgtgtgtgtgtgtgtgtgtgtgtgtgatagagtcttactctgctgcccaggctggagtgtagtggcacgatctcagctcactgcaacctctgcctctcaggttcaagtgatcctcccaccttagcctcccgaatagctggaactacaggttcgtgccatcacgtctggcaagtttttgtatttttagtatggacgggggtttcaccacgttgcccaggctggtctcaaactcctaacctcaggtgatccacttgcctcaccctcccaaagtgctgggattacaggtgtgagccactgcacccggcctactgggatattcttgaaattgcctactgccccaaaagtacagagcctagaacacataatatatgatcaattagtatgagttgagtgaacaaatgaaactccagtatcatcagatctagagtatgaagtggaaatatcactggatttcaggagacaaacctgaatttgagtccaaataccactatttattaggcttgtgataccacatccttgagattcagtttcttcccctgtaaaagaccaagactcttaccctgactaccatgcagacttatctaaaggaggaaaacaggagaaaatacatgagagttatttgtaaattgtgaagcatgtgacacatgtaagttgtcaggcattttagagctgaagcatcatctaaagcattcctcttgttaaacacaggaatactgaggctcagagaggggaaagtcacacagtaaggtaatggtatggcagagcctagagagaccaggtctcttcactgtcagcccagttctttttccattacaccacaattattttgtgtttccctaaaaatgaggaaagatgctgagaatgtgaggagaccaaggcagctgaagttagccttacagagcaccaaagaaggaagacatgcacagagagaattagggagattcttagagagtctctcttgagcatttggcagagcactaatcaacatatgcacataataaaactagcgaaggctagagaaggaatctcccaaataattcaaggaatctgttcttggaattcacatagggctgggaatagagctagttcccaccagccagcctgaaaatctcatgattcacagggcatatggcattctgaagggccttgcctcagtagtaggaaataactaaccctacaacaaatgctgccctattccttcctaaaatattaaagaaagatctgataggatagaactgtttactatgaaaaaagttcaagatcatttacaagaatggaaaaaatatccagcacactcagtaaaatataggcaaactgaatccagcaacatatgcatttaccatgaccaagtaggatttatcccaggaatgcaaagttggttcactaactgaaaatcaattaatatagcctcacaatcatggcaaaaggcaaggaggagcacgtcctgtcttacatggatggcagcaggcaaagagagaatgaggaagacgcaaaagtggaaaccctttataaaaccatcagatctcatgagatccatttaccattatgagaacagtgtgggggaaaccgtccccatgattcaaccatcttccaccagatccctcccacaacatgtggaaattataggagtataattcaagatgagatttggatggggacacagccaaaccatatcaacatatatatgtaagaggagatttattatgggaattggctcacataattatggaggctgaaaagtcccatgatatgccatctgcaagctagagaactagggaggctagtggtataattcagtatgagtctgaaggcctgaaaactagggagtcaatgataaaaccctcagtctgaggccaaaggcctgaggaggtaaggggcactagtataagagctggagttcaaagaccgaaaacacaggagctctcatgtctaagggccaacgaaaatatatggcccagctccaaaagagagccaattcactcttcctccacatttttgttctatgcagttcttcagaggattggatgatgcccacccccattggtgaggatgattcttctttactcagtctattgatttaaatattaatctctcttctggaaacaccctcacagacacacccagaaataatgttttaccagctatatgggtatcccttaagccagtcaaatgaacatataaaattaaccatcacagtaacatatcacaccaatggaataaaagaaatcataagattatctccatacatccagaaaaacatgacaattctaacaccctttaatgataaaaacacaacaaactaagaatagaagaaaacttctttaacctgataaagagcatctacaaaaaaaacccatagctgagaagaaaagccacagactgggagaaaatatttgcaaagacatctctaaaaaagaactgctatccaggagaaaatgtggcacacatataccatggaatactaagtaaccataaaaaagaatgagattatgtcctttgcagcaacatggatgcagctagaggccattatcccaagtgaattaatgcagggacagaaaatcaaatagtgcatgttgtcacttataagtgggagttaaacattgggtactcatggacataaagatggcaacaatggacactggagactacttgggggagggagagagttaagagttgaaaagctacctattgggtaccatgttcagcacctgggtgatacgatcatttgtaccccaaacctcagcatcacgcaatatatccaggtaatacattgcacatgtaaaaagaattctaaaaattcaacaaaaagaaaatgaacaatgcaatttaaaaatgagcaaaatacctgaatagacacctcatcaaagaagatacataaagaaggtatatccaggctgggtgtggtggctcacgcctgtaatcccagcactttgggaggccaagacgggcagatcacgaggtcaggagttcaagaccagcctggccaagatggtgaaaccccgtctctactaaaaatacaaaaattagccaggcgtggtggcaggcgcctgtcatcccagctactcaggaggctgaggcaggagaatcacttgaacccgggaggtggaggttgtagtgagctgagatcgtgtcactgcgctccagcctgggcgacagagcgagactccatctcaaaaaaaaaaaaaaaaaaaaaaaaaaaagaagttatatccaaagaagatggcaaataagcatgtgaaaagatgctcaacatcatatgtcattagagtattgcaaatcaaaactacaatgagataccactgcacaccactataatgacaagaacactgatgacaccaaatgctggcaaggatgtggagcaacaagaactctcattcattgctgacggaagtgcaaaatggaacacccactttgaaagacagttggcagttccttacaaagttaaacatactcttaccatatgatccagaaattgtgctcataggtatttacccaaatgaattgaaaacctgtgtccacacaaaaaccttcaggcaaatgtttatagcatctttattcacaattaccaaaaacttgggagcaacctagatgtccttcagtagataaatgaataaataaactgtggacatccagacaatggaatatcattcagcactaaaaagaaatgagctatcaagccatgaaaaaatgtggaataaccctaaatgcatattgctgagtgaaagaagccaatctgaaaaggatagatactatatgattccaactatatgacattctggaaaacgcaatattatgaagaaaataaaaagatcagtgcttgtcagggcttaggggagagaaagggatgaataagcagagcacagataaattttatggcagtggaactctttgtatgacagtataatggtagatatgtggctttatgtatttgtcaaaacccacaggatatacaacacaagagtgaactttaatgtaaatgacggactttaggtgataatgatgtgtcaatgtattcattgattgtaacatatgtactattctggtggggaatgttgatagtcggggaggctgtgcatgtgtgagagcagggggtacatgagaattctctgtactttcaattttgctgtgaacctaaaactgctctaaaaataaagttttttaaaaaaatagctaacatcatacttagtaaatgtttccctcctgagatcaggatcaagacaaggatgtctgctcttaccacttctattcaacattccactagaggtgctatccacggaagttaagcaaaaaaagaaataaaaggccttaagattggcgagggaaaaataaaactacctgtattcaccaattatatcatcttacatatagaatattctaagggatgcactaaaaaactattagacctaataaaaaagttcagcaagattgcaggtataagatcaatatacaaaaaccaactgtatttctatatatttgtaaacaacaatccaaaaataaaattaagtaagtaattccattcacgatagcatcaataaaataaaacgcttaggaaaaaaattaacaaaacaagtgcaaaacttatactctgaaaactaaaaaacattgttgaaacaaattaaagacataaataaatgggaaaacattccatgttcatgaatcagaagataacattgttaagcaggcagtgctctctatttgagctacagattcaaagcaatccttatcagaatcccagttgacttatttgtggaaattgacaaactgattttaaaatcatatggaattgcaagaaatccagaatagtcaaaacaattttgaaaagaaacaaccaagtaaaatgcacatcttaattaaaaatatactacaaagcaatggtaatcaatacagtatggtagtggcacaaggatagacatacaggtcaatgcaatagaattgacagtcatgaaataagcctatatatctatctatggtcaactgattttcaacaatggtgccaaaattatccagtagggaaacaatagtattttcaacaaatgttgctcagacaactggatagccacgtgcaaaagaatgaagttgtatacttacttcataccatataaaacgtgtttaattcaaaatggatcaaaagcctaaatgtaagagctaaaaatataaaatatgtacaagaaaacatacaggtaaatcttcatgatcttggatttatttggcaaagcagttttaggtatgacacctgatatggtttggctctgtgtccccacccaaatctcatctcgaattataatccccatctgtcgagggagggacctggtgggaagtgactggatcatggggggcagtttcccccatgccattctcataatagtgaggaagttctcatgagagctgatggtttcaagtgtggcacttcctcactctttcactctctctcgctgccaccaagattgtgaatttcctgaggcctccccagccatgaggaactgtgagtcaattaaacgtactttctttataaattacccagtctcaggtatatccttacagcagtgtaagaacagactaacacagagaattggtaccgaagtagtggggtactgctataaatataacctgaaaatgtgggagtgactgtggaaatgggtaactggcagaggttggaagagtttgcagggatcagaaaaagacaggaagaggagtgaaagttggaacttcctagagacttgttgaatggttgtaaccaaaatactgatagtgatagggacaatgaagtccaggccgaggtggtctcagatggagattagtaacttaatgggaactggagccaaggccactcatactattctttagcaaagatactggcaacgttttgcccctgccctagaaatctgtgaaactttgaaggtgagagagatgatttagggtttctggcagaagaaatttctaagcagcaaagcattcaaggggtgacctgtttttttcctgaaagtgtacagttatatatactcacaaagagattgtttgaaattcgaacttatgtttaaaggggaagcagagtgtaaaagtttgaaaaatttgcagcctgcccatgtggtagaaaataaaaacccattttctggggagaaattcaagccagctgcagaaatttgcataagtaacaaagagccaaatattaatagccaagacaatggagaaaatatctccacagcatttcacagattttcaagacagtgcctcccataacaggcccagaggcctaggagggaaaaatagttgctatatgcagcttcaagacatggtgccctgcatcccagccattccagctatagctgtgcttaaaagggaccaaggtacagcttgggctgtggcttcagaggttgcaagccctgagccttggcagcttccacgtggtgttggccctgcaggtgcacagaagtcaagagttgaggtttgggaacctccgcctagattttagaggatgtatggaaacacctggatgtccaggcagatgttctgctgcaggggctcctcatggagaacatctactagggcagtgcagaaaggaaatgtggaatcggagcccccaaacagagtccccactggggaactgcctagcggagctgtgaaaagagggccacaatcctcaggaccccagaatggtagatccaacgatagcttgtaccgtgcacctggaaaagctccaggcactcaacaccagcccatgaaagcagctgcagggtctgtaccctccaaagccacaagggtggagctgcccaaggccttgggagcccaccccttgtatcagtgtgctctggatggagtcaaaggagattttggagctttaagatttaatgactgcctggctgggttttggacttgcatggggcctatggcccctttgttttggccaatttctcccacttggaatgggaacatttacccaacgcctgaacccccattgtatcttggaagtaactaatttgcttttgattttataggctcatagacagaagagacttgccttgtctcagataagactttggacttggacttttgagataatgctggaatgagttaagaggttgagggactgttgggaaggcatgattagctttgtaatgtgaaaatgacatgggccaggggtagaataatatggtttggctgtagtttgagattacaaatctcatctcaaattgtaatccccatgtttcgagggagggacctggtgggaggtgattggatcatgggggtagtttcccccatgctgttctcatgatagtgagggagttctcatgaaagctggtggttttaagtgtggcacttcctcgctcttttgctctgtcttgcctgctgccatgattgtaagtttcctgaggcctccccagcgatgggaaactgtgaatcaattaaacgtcccttctttgtaaattacccagtctcaggcagtatctttatagcagtgtgagaatggactaatacaacaacaaaagcattaacaacaaaaatatatagattaattggatttcattacaattaaaaacttttttgcttcaaaaaatacaatcaagaaaatggaagggtaactcacagaatgggagcaaatatttgtaaattatatactggtaaaggacttatatctagaacacataaataacttttacaaagacatacagcacaatttaaaactagacaaatgatctgaatagacatttctccaaggaagatatgcaaatgactaataatcacataaaaggatgtttggcgtcattggtcatcaaggaaatgtacatcacagccacaatgagataccacttcctaccgactaggatagttagaataaatgtcagagaataacaagaatgttataggcaagaacgcagagaaatcagaaccctcacatactgcagatgttaatagaaaatggggagccactttgaaaaacagtctggcagttcctcaaacaattaaccatagagttactatatgacccagtaattgtattcctaggtacatacccaggagaaatgaaaatatatactcaaacaaaaacttgtacaggaatgtttacagtggcattatttatagtagccaaaaggtgaaaacaacccaatggatgaatggataaacaaaatatgttatatctatataatgaaatatactaatagtaagtgaaagaagccagtcacaaaaatccacacagtatgcgattccagtcatttgaaagcacagaatggtaagtctatggagacagaaagtagattagtagttgcttatggcctggggggaaggggagtagtaatgggaagataggaggtgatagctaaaggatataaggcttctttttacggtgatgaaaatgtactaaaattgactatggttatgtagcacatatctgtgaatagactaaaaaccatttaattgcatactttaaatggatgaattatatggtatgtgaattatacttcaataagctgtttttaaaaaaatatgcagcacacaacaagataaaacacactatgcagggcatctaatgaaatattaccagacatgcaaagaagtaataaaaaataaaagactcagaatgaggagaaaaattaaccaaatccaaccccaaaatgaaacagatgttaaaattatcagacaaagagaataaaacagttattacaacagtattctatatattcaaaaaggtacagataagaatgaacacattgtgtaatgacatgtcagatataaaagaagacctaagttgaatttctagagatgaaaactacagtgtcagagacgaaaaacacactgaatgaaattgatggcagagtagaaattgcagaagattgaaagacataggaataaatactatccaaaactaaaacacagagaaaaaaggactaaaagaaagaaaagaaaaagaacacagaaccagtgaactctgagacaacttcaagcagcctaatatatgtgaaatggagtccacagaagatggagggaacagaaaaaatatttgaggggataatgaccaaaaattttccaaatttgatgaaactatacacccatagaaccaagaagctcaacggagcccaagttcaagaaacatgaagaaaactatacccacacaaatcagaaccaggttgctcaaagcaactgataaagacaaaaatcctaaatgcagccagaggacaaaaaagacatgttatgtacagaggaagaaaataaaggaaaaaaaaaaaagaaaatacaataaagaaaaacaaaggcaacagatttctcattggaaacaagacatcagtgatgctttaaacataaagtcttgagtaaaaaacataactgtcatcctataattctgtatccagtgaaaatttctttcaaaaacaagggtaaaataaagagctcttcagacatacaaaagtcaaaagaacatcataaggaatagtaaaggacatcctttagactgaaggaaaatgataccagttgcaaatatggatctacacgcagaaatgaagagcactagaaatagtaattatgtgcataaatgcacatcattctcaaattatttaaatcctttcaaaagataattgtctaaataaaaggaagaaatgtaaatacattatagcaaaatttatgagatggcaataaagcaatattcagagggaaattaatacaactaaagatctgtattagaagtttcttaagttctacactaaacaaccagaaaaaggagagtaaataaaaccaaaagtaagctaaggaaggaaataataaaaaaccagagtggaaataaataaaatgaaaaccacaaaagcaatagagacaactaataaaaattcaaaagctagtttttgagaacatcagtgtaattgataaacctagccatactgatcaggaaaaaaagaagacgcaaatcaccaatatcaggaataacagaagggacatcactccagaatctacagatataaaaaagataatctgaataaacatatatatatatatatatatatatcctgatatataatatagataatatatagatatatctgatatataatatatacctgatataatagccaggtaggtatatagacaacttggatatatatttttttaaatttgaattcaaccttaaaaccttcccacaaagaaaactacaggcccagataccttacctggagaattcgacctaaacataaaagaaggtgtaattccaattctgcacaaatgatttcacaaaattgaacaggatgaagtaagtcccaacatattctatgaggccagctgtactctgataccaacacccgacagacataataaggaaaactactgatgaatatccctcgtgaacagaggtgtaaacatcctaagcaaaatatggcccagtaaagtttagcccagcattcaaggttagaaaatcaaataacgtaattcacttcagtaacacagataatccatataatctaaacatctaaaaagatgtatgagcaacgctcaacaaaattttaaattgattcatgatataaaatcttggaaaactaggaatagaataaaacgtctttaatttgataaatggcatctaaaaaaggaaaataaaacatagcaatattatcattaatgatgaaaattcaaaatcattccctttaatatcaggagctatacaaagtgacctgcatttaatagtctactactactaataggcacttgggccattgtttgcaggttatccatccatatattccttagtttggagaaattctttcatatgttcatctagagtcacagaagtagtgtttgcaatgtgcgtaaactggaaacaatgacccaaatgcccattagtagtagaatacacaatagtttgacagcagtgaaaatgaatgagctataatcataggcatctcacaaagctgaatctcaggagcataatgaacagcaaaagaagcaagtcacaagagaaaatataatatggctccatttatataagattaaagaacagacaaccctaaacaacatcaacagttggtaagggtataaagaaaagcagataaatgatttaacctaacattaaggatagctagcttgtagtttgagagatgaagagtgatgtgatatggtagaagtttatagggatttccaagggactagctatctgtccattttataatttaaactgtacacaaataatttatatacccttttgtatgtattatgtggctcataaaaatttttaagagtaaagtgttaagaataatcaaaatattttgaagaagaaaaacaatgcaagagaactcattacaaatgaaacaaaacagagactctagaaacagctcctcacatatatggaaatgagtagggaaaaagacagcacattcagtatataatccttggatgaatggttatctttctataaaaagataaaaacgtaaaagcacatctttccctaacatcttaccaaaatctttgtcaattttcaggcagataaaaaaactaattataaaaataaaatctttaaaactcagaagaaattttataagaatattttttatgacttctgggcacaaaaaaaattacataagtaaaactcaaaaagaataatgcataaaaattgattattttgattacattaaaattaaaaattgtcgtgcatcagaggacatcaggggaaataaaagcaatgtaattgaagaggtatttaggacacttattcctcacaatggattagtatgcagaatttatgaagaactcctataaatcaatactgaaataaacatatatattaaaagctgtgcaaaaagtagaaacggaattcacagaagagggaacctgaataaacttatgaaaagttgttcaacctcactagtaggcagggaaatgcaaattaaaaacatacccctcagattggcaaacttttaaaagtctgataataccaaattgactcagaggtgagaaactggaattctcaaatactgctgcagattgtgtaagttggtacggccactttggagagtgatttggaaatatttaggtaatattaaaggtaaaaaatgtgtatacccaatgacccagagattatactcctagatctatgccctaaaggagcagttctgcagactgttgggggtgtctgtacccttttaaggaggttcactagatcaagacaattttcataacactaattcattatttggaattttttctttcaggaaggtactagtggagttttcaagaggctacatgacatgtgatagcacaatatattgaaggtgaaacaggtagaaaactccagttgtctttattaagccagatgttagagatttgcaaatacataaaacaataccactcttcccactacttttgttctggaaaatataattattttcattaaaattttatttctaagtgaataaagaaatacatttaaattttgttttaatttttataatgttaagtagtgatataacccacataaacaaaagcttttcggggtcctcaataacccatggatctccaattggattcattcaccaaatatttcctaagcaccttctctgtgccaggcccttggctaggaactttgtggcagaggcagcactcacttcataagtgatacaacacaccccagttctgagactccagctaggtctggttgattcctccacaggcaggtgacttcacagaagctttaggctattttgtctacagcactgagagctttggctactttcatccttcctgcccctgagctattggaattctgttgttccaccattatgtaactactatggtcatctaccaatctgaggacacagaacccaggaagattccagtcggtcccagtgccacctgtgctcctagtttcagtcaaataagttgccaagtcataggaggaaaatagaaacaggccacatctgtgcccatacttgtcagccatgttcaactagttgccactgcagaacccttgacttgagtgctattacctcttagctctactcaccaatcattgtagaccttagatataagcccagagacccacagttatgaagattatggggctttccacaaacaccagtacaatacccctgttctactaatctgagcacatgagtgttactggccactgagaggactgtctgctgcactcagcactttcttcagttcattccacaaatgtctggctcaccacacttttctgaaggtctcctctgtgccaaattctgagacatgtatgtttttgtattttcttcacttagtccttctaacagccctgacggttaaccatattatatttgtacagacccagcccatagctggatttcagtactgatgctaatgctgcctgatttctggtgctatttgcgaaatggaggatgatggtaacaatgacaacagtgatctggtctcatgaactttgtgggctgtccatttgtaaacaggaatgtctctctatgcattatctatctatcaatatgtattttgatagacacacatatctgtgcatatgtgtgtatatatatagatataaatacgctgttccctaatttgttattgccaatagtgggtattatgctcatcttatagataagggagggatcagagtcacaactgtggttgtcacttgtccaaagtcacaaagcacctaattggtgggtcccggcttcctgcctagtctgatctgactccatgagctttactaacagtcttcttcccccaccctatcctaaagcctccctctgattcatcagtagccatctcacttgcatgcagctaagtccaaagaatcccagagtaaaaaagtaaatagaatgggcagcttcctcagagcccacccagatctactgtgggtcctactcccaatgatgaagattgacaaggaaaaccttctgaaaactaaagagaggtcatgacccctacagatcatttctgctattaactagctgtgtccgtgactagtttactctcctctgagcctcagtttcctagcccattgattgaggcaattggattaataatctaaattactttccagctctgaaattctataactctagatataaaataaatcagtttttctttgtgaaaatcaaagtactctgatttgaatttccaagactagagtgcatgcttgtgggctagccgatctgtagtaggcaccaatattatacagaagagaacctcttgaagaactaaaaatcaaagcagcctgaccccataccacttgggcaaagttgcaatgcagcacagcaaaacatcaagcctagttcagctgccaccctcccccattatgacgcttgtgaatgtcatttgtctgctagcttcacatgatcccctatagactaagtgcctgctagtgtgagggaatgaaagaagtactgacctgggaagtaaacaatctaagttcaggtctcagttcaggcagttctgagctgtttcacctggagccacttgtttcacctctctaagcttaagcttcctccttcataaagtggggtgacagttcttgctctgtgtggctgtcaccggattattgtgcactttaatgaggtagtggcagccaaactaccttaaaaatgtaatgtagtcaatgtaaattttatccgatgagataaatgagaacaagagctaagatatctccaggctcaaggattcctccacagaattcagtgtgagcagctagccagaagaggtaccagtcacacttcaaacttccccggcagtattttgctaaaagctgagcaaagacatcttcccagaaaaatctaaggacaggagctaataagtgagcccagcacttgatttaagagtaggattcagtttggtcatgaccactaatggtacacctaccttgtgtgcccaaaatcagagtagggtgctcacatgcccagccaacctccacggcttgggaaaagtctgggtctctccactgttgactacccaatggcaaacggtggaaatatgcttgataggtggaaaataaaatcagtatccgatggagaggagggttgcattgcccagcctggccatcctctttcccagttagattacctcatctcttccccagagtgggcttcacagaggccccaggggaacaggccgtccatcctgggctcaaacagttgggtgattcttaaaacaccatccattctcactaaatccccaggaactatgaagagcagaattggctacattgacaacattatctttactgggtgacttttcttttcactgggagactgaaagtaaattactacaagaagaatcctttttgtggtctaggcagccaatgccaactggaattgaagcagcctgagggcacttgagagcctgtgcagccagtcagccaggtgggtgggaagacatacaggcaggcaggcaggcagctgggcaggtgggttggcaggtggggcctgctaggggtgagaaggggaatagtgaccagggggagccagctggccaggaagaaagaagacataatttgactggactcaactatttgctcaccatcagattgaaatccaatctagatatttgcagttgttaaaaaatcttcagctatttcaaagagcaaaaggagacctaggtgtcatgtacctgttcttcctcatgtcctgagagctagaagaggcaggacgtcaatctgctgaacctggaccataagtaagcctactcagtagacctcttcttgatgacactgactgttcatcctcatcatcattctctgttttccaagctcgagtcaaaaaaattctcaaactcccccaaatctcagcaagttcatctatcctaaccctaaccctatggagagcctctcctgaccataggctcctgagagccacactgcccaggacccaaattaaatccaagccttcaggatgatagtggcatttgcatttatgttgtttggccttggttgccacatggtaccctgctaatagtaggacagaatacctaaggattgtttacagtgcctcctggatcatcactgccaataatctccacagttcctcgaattcattgtctaactaaattcattatcttcctttccgtgctcacccactcccacactgttggtgagtactgaggaccaacatgttcctagaaccccaagccagaaaccttagcttagatttcaccatggatacaaagctaatagtggctactacttactgaatgcttatccagcactaagcagtgtacgtccattttgattgtctggttccattgattttatatccttaatatcacatgaaacactcatcattgcatagttcaaccttgtaccatctcttgtctgaacactttcagcaacttcactcattcatttattcaaacagtatttagtgaggctctagtacatgctaggcactgtgctgaggattcaatgataagcaaaacacacccagttcctcctcccatggagcgtatgttccagaagagaacacaaagtttaaactagttggacaatccattcatactctagatatagtcagctttccctttctaaaatacatgtctgtcctttcaaagaactatccccctacaaccttcaggataaggcctgaacttgttaacttgacattcaagtcttggcaagccttttacaatttgcctttccaaactcaataccaagtcatctccctaagacagaagaagacacacacacactcacattcctcttttctgctcccaacatcccagaaccagccagattagatgacatgtatgttcttcaaatacttcatgcattatcacatctgcatggcttcagacttcctctaaaaaccagagtttctaagggctcttcccactcaggcaggctggtgtcccaggaaaccagattgcccatattgcaaccaaatgttgagagaaagccttgacaaccacctcccaaacccccgcctctgcctgtaattcccatcccccttttacttggtgaactcctacttatccttctggtcccaacttggccttcaatgccccacccaccacctttccctgctgccccaacctgcacaaagtatccatcctttgtgtatccctcctggtctctcatcattgtttgtttactgtctgtctcccctagaggggagaggatagaggggccttatttaccattctatccccagtgcatgccacagagttggtactgaaggaatgaattgttgaatgaatagatgaatgaataagtgaatctttaataaaaggccagagtttggtccgttcactgcagcaaagttttcatttcagtccccaaaagcagactggaagttctctgaaggacagggacacatctatattaatagctgatttttccacagcacctagcatttgttccctctatgtgcttctgtatctgggtcccaatatccctgttttataaggacaacagtcatattcacttagggcccaccctaatgaccttattttaccttgattacctctataaagaccctatctccaaataaaatcacatttctgaggtactagggattaggacttcaacatgaatttaaggagtaggggtcacaattcaatccataagattttttttatattttattttattttattttattttatttattttattttttgagatggagtcttgctctgttgcccaggctggagtgcagtggcgtgatctcagctcactgcaacatccacctcctgggttcaagcaattctcatgcctcagcctcctgagtagctgggatttccagacatgtgccactacacctgggtaatttttgtatttttcatagagatggtgtttcaccatgttggccaggctggtctcaaactcctgaccttaagtgatccacccgcctcggcctcctaaagtgctgggattacaggtgtgagccaccgcgcccggccagaattttgccctattcttcaacaacatgtttcttaagtcagcactgtagactccaagtacatttcttcccattaggaaaattttattacctattttatgaatattttccccagtattttgcacagtcatgacccagaagtgaagagaaaaagatatttctggttctaagataaaaattaaaaatattgaaaaaacaaagccaaacattgttgacaattattaacaaacactggtacttggagtcattcaaggataaaggggctctatctgcctcctctcaagacagctgggcttccatgtgccttgcctgattgagaaggggtcattgtgcaccctggagtaaaaatgcctctcttttccctttatgaagtacttctccctggaagtgcaatgcattttaaaatgctttttggtgtctgtgtttgcatctagtgccacaagtcacaccgagttgatgctgcaagtatgttctgcgattaagcttctaatatccatcaagcaagaagaaaaaaacaaaagagaaaggagaggaaatttatcctggaaaataataataaaacactgaatgactttgaagtgtgatacttaataaaggaaatgtgtgaaaattgaggcaaagacattttgggtgggtgaatttgctctggaatagcagctgttaatttgaattttagctctatgtagtaggtttcacataatgcaaaacagtgtttcccctaatatattagtacaagcaaaaatgcatgttgttaatatgagtgctctagttaagacacctgtgtgagctctggttttctcccagatgccccagtcagtaatgcataacatgttggcccatatggaaattgtaagctttctgttcaacagtactgctttctagatgaactcccagtacactctggaatttagtaacttgaactctgtaggatgctgttggtcttatctgtccttaactacctgactcagtgtcctggaatgcttgtgagaaggcaatccacactgtagaccccagagattactcaacccagtgctactcaaagtgtggtccacagactggtgccagtacacaaaaatattggtttccagtataataaggcaggcatagaaattgaaaataagctttgatacgtgtatatagcaatttgacagaatacttttatgtctgttgaataattaaaagatgagtttgtattttgtatatctttttcatttttatagtaatttatttttattttattttgaaaagcatttgtgatgattagaaaaaaattttaaacttttgttttaagttcaggggtacatgtgcaggtttgttacataggtaaactgtgtcataggggcttgtacagattatttcatcatccagatattaagtctagtacccattagttatttttcctgatgctctccctcctcccacccatcaccctctgataggccccagtgtgtgttgttcccctctatgtgttcatgtgttctcatcatttagctcccacttataagtgaaaacatatggtatttagttttctattcctgtgttagttttcaattggttcttccctatggatggttaagaagccctaatttagtctgccttccccattccagaaaaggtcaagactccttaggattgaccctgggttcctccaggttctgtaaggttataagaaaaactcaaatttctactgcattcaagtcaatatttattcattgcgtacttacgagacaatgggctatgtgcttggggtaccttagtgatcatgacagaaagagtccaaagatttgttgactacctgtattcttgacagagcttaaaatccagcaaagtataaattgtaagaaagaatcaaattatctccaattccacccaggttgctgcaaatgccattttattgttcctttttatgactaagtagtattccatggtatatatgtaccacattttctttatccactcatggattgatgggcatttgggctggttccatagttttgcagttgcaaattgtgctgctataaacatgtatgtacaagtatctttttcatataatgacttcttttcctctgggtagatactgaggagtgggattgctggtagtttaggaatgaaaaaagaaacttcacatgttctcactcataaatgggagctaagctatgaggacatgaaggtataagaatgatacaatggactttggggacttgagggaaagggtgggagtggagtgaaagataaaagactacacgttgggtccagtgtacactgctcaggtgatgggtgcaccaaaatctcagaaatcaccactaaagaactttttcatgtaacaaaacaccacctgttccccaaaaacctattgaaataaaaaaagaaagaatcaaatggaaatggtagaaatgaaaaacaggaacagagatgaagacctttgatgtactcaacagtagaattaacacaaccaaggaatgagatgaaataattccattcacaatagtttcaacaaaaataaaacactcagaaataaatttgccaaaagaactgcaagacgtacacactgaaaattataaaccatggctgaaagaaattaaagacctaaataaatggtaaaagacttttttttttttttttgagacaaggtctcactctgtcatccaggctggagtgcagtgtcatgatcatggctcactgcagcctcagcccccaggctcaagcgatcctcccagctcagcctcctataggcacgggctaccatgctcagttagctttctatttcttgtagtgatggggtcttgctatgttgccaggactggtctccatcttccgggcttaagtgatcctcctgccttggccctcccaaagtgctggtattacaggcacgagccatcatgcctggccaagatatctcattttttttttttttttgagacggagtctcgctctgtggcccaggctggagtgcagtggcgcgatctcggctcactgtaagctccgcctcccgggttcacgccattctcctgcctcagcctcccgagtagctgggactacaggcgcccgctaccacgcccggctaaatttttgtatttttagtagagacggggtttcaccgtgttagccaggatggtctcgatctcctgacctcgtgatccgcccgcctcggcctcccaaagtgctgggattacaggcgtgagccaccgcgcccggccctcattttttttttgagacagagtcttgcactgttgcccaggctggagtgcagtggcatgatcttggctcactgcaagctccgcctcctgggttcacgccattctcctgcctcagcctcccgagcagctgggactacagacgcccaccaccatgcccggctaattttttttttttttttttttttattagagatggggtttcactgtgttagccaggatggtcttgatctcctgatctcgtgatccgccggcctcggcctcccaaagtgctgggattacaggcgtgagccaccgcgcccggctgatatctcatttttaaggattaaaagaattaatatttttaggatggcaatattccgctaattgaaatacagattcagtagaatccctatcaaaattccagcctcactttttttgttttttgcaaaaatgacaagctgaccctaaattcatatggaagtgttaggggacccaaaatagtcaaaacaatcttgaaatagaaaaacaaatttggaggactcacattttccacttctaaacttactacaaagttacctattgacataaggtactgacataaggacagacatatagatcaacggactaaataagcccatacatctatgatcaacttatttttgacaaaggtgacaatgtcagacaataagagaggagtagtgtcttcagcagtggtgctggaaaaactggataaatggtgctggaaaaactggatatccacatggaaaagaatagagttggatccctatcacatacaatattaaaaaaaaactcaaaatggatcaaagacttatactgtaagagcaaaagctataaactctcagaagaaaacataagtataaatctttgtaatcctggattaggcaatggccttttaggcaatggtctcttagacatgatacctaaactataagcaaccaaagaaaaaaatagataaattggacttcatcaaaatttaaaacttttatgttcaaaagacactatcaaaaaggcgagaagacaaccaacagaatgggaaaacaacatttgcctgtcatatatctgttaagtctctagcatccagaatatataaagaactcctacaactcaaaattaaaagacaaataatccaataaaaattgggcaaagaatttaaatagacatagaattttaaaagaaagtacacaaatagccaagaagaacatgaaaagatgatctacatagttagccattagggaaatacaaatcaaaaccataataagataccactttaccctctgaaagatatctataatccaaggtaaacattaagaagtgttattgtagatgtagagaaattacaactctcacacataggggttggaatgtaaaatgatgcagccactttggaaaacaattggcggttcctcaaaaagttaaacatagaactgccatgtgacctggcaattctactcatagctacagtaattgaagctagcaattgaagagaattgaaaacatatatccccacaaaacatgtacatagatgttcatagcagcattattcataatagccataatgtggaagcaactcaaatgtccatgaactggtgaatggataatcaaaatatggtatattcatataagggaatagtattcagttataaaaaggaatgaagtactgatacatgctataacatggatgaaccctgaaaacagaatactgacacaaaaagccatatatcatatggattccatttattgcagaataggcaaatccatagagtggatttaaagagtgaccgaagatcacctacctctacatgtaaacccaagtcaaattctaagagtcagtcaaaggcaaagatcacctctatgtgtaaaccatcatttgaaactgatttctcacttgtacaaagaaaaacgctttggagcaaaacagatagaaaaagactgcaaatactaacacaaaaatggcctgagctctttcagtctttctgatgaaggcgtttagggctatgaactttcctgttaccaccacctttgctgtatcccaggggttttggtaggttgtgtcattattgtcattcagttcaaagatttttttaatttccatcttgatttcatttttcacccaatactcatgcaggagcaggttatttaattcccatatatttccatggttttgaaggttccttttggagttgatttccagttttattccactgtggtctcagagcgtgcttgatatagtttcaattttcttaaatttattgaggctcgggcctatcatatggtctatcttggagaaagttctatgtgctgttgaatagaatgtatattctgtggttgttggatgaaatgttctgtaactatctgttaagtccatttgttccaaggtatagtttaaatccattgtttctttgttgactttctgtcttgatgacctgtctagtgctgtcagtggagtactgaagtcccccattattattgtgttgccatctatctaatttcttaggtctattagtaattgttttataaatttgggggctccagtattaggtgaatatatgcttaggattgtgatattttcctgttggacaaggccttttaccattgtataatgttcctctttgtctcttttaactgctgttgttttaaagtttgttttgtctgatataagaatagctacccctgctcgcttttggtgtccatttgcatgaaatgcctttttccacccctttactttaggtttatgtgagtccttatgtgttaggtgagtctcctaccctccggtatctatcattctactctttattgccatgcgatccacttttttagcttccacatatgagtgaaaacatgatatttgtctttctgtgcctggcttatttcacttaacattgtaatatccagttccatccatgttgctgcaaatgataagatttcattattttttatagttgaatagctctccattgtgtatatgtaccatactttatccatttatcaattgatagacacttaggttgaatccatatattggttattgtgaatagtgctgcaaaccctgagagcacagggcaccggagagattgcatgctcaaaagatatcttaaaaaatgataaattttaaaatatatttgtggacaagtattttaatattaaattgctatgataatgattattaagtgaataaacactatagaatcagattttaaaagctagtaagcacctcagagatgaaagttataaccctcaccatactctccacctctgctagtacttcaaagatctttcacctaacccttttttctcttttctatcatatcacaaacaccttattatatttattctttgttgtttgctgtttgccctcccatgcccaacaaggatggaagccccatgagggcagggatccttgcctgttttgtttgctgatatatcccaaccccccacaacagtgcctgagcagctactcatttgttgagtgaataaaactcaactaacagccacttgttttagtttaacaaactaatagtggactaaaactggaaatcaactcaaaaaggaaccttcaaaatcatgcaaatacattgaaattaaataacatgctcctgaatgatcattggttcaaaaatgaaatcaagatggaaacttaaaaattctttgaactgaacgacaataatgacacaacctactaaaacttctggatacagcaaaggcagtgccctaagtgcttacaacaaaaagactgaaagagcacaaactgacattctaaggtcacacctcaaggatctagagaaacaagagcaaaccaaacccaaacccagaagaaaggaaataaccaagattagagcagaacgaaatgaaattgaaacaaaataacaatacaaaagataaatgaaacaaaaagctagttctttgaaaagataaataaaattgatagactattggcaagattagccaagaaaagaagagagaaaatccaaataagctcactaagaagtgaaacaggagatattacaactgacaccactgaaatacaaaagatcattcgagactactatgaacacctttacacacataaactagaaaacctagaagagatggataaattattggaaaaatacaaccctcctagcttaaatcaggaacaattagataccctgaacagaccaataacaagcagtgagattgaaatggtaatttaaaaattaccaacaacaacaaaaagtccaggaccaggcagattcacagcagaattctaccagacattcaaagaagaattggtaccaatacttttgacactattccacaagatagagaaagaagaaaccctccctaattcattctatgaagccagcatcaccctaataccaaaaccaggaagggacataatctaaaaagaaaactacagaccaatatccttggtgaacatagatgctaaaatccttaacaaaatactagctaaacaaacccaacagcatatcaaaaaggtaatccaccatgatcaagtggatcacatatcagggatgcagggaatgtttaacatacacaagtcaataaatgtgatacactacataaacagaattaaaatgagaaatcacatgatcatctcaatagatgcagaaaaagcattcaacaaaatccagtatcgcttcatgattaaaactctcagcaaaatcggcatacaagggatctttcagtatctaataaataccttaatgtaataaaagccatgtatggcaaacctgcagccaacatagcactgaatggggaaaagttgaaatcattccctctgagaactggaacaagacaaggatgtccactgtcaccactcctcttcaacatagtactggaagtcccagccagagcaatcagacaagagaaagcaaggacatccaaatctgtaaggaggaagtcagaccgtcactgtttgctgatgatatgatcgtttaccttgaaaaccctgaagactcctccaaaaagctcctagaactgataaaagaattcagcaaagtttccagatacaagattaaggtacacaaatcagtagctcttccatacaccaacagcgaccaagcggagaatcaaatcaagaactcaaccccttctaccattgctgcaaaataataataataataataataataataataataataataataataataaaatacttaggaatatacctaaccaaggagttgaaagacctctacaaggaaaactacaaaacactgctgaaagaaatcatggatgacacaaacaaatggaaacacatgccatgctcatggatgggtagaatcaatattgtgaaaatgaccacactgccaaaagcaatctacaaattcaatgcaatctccatcaaactaccaccatcattcttcacagaattagaaaaaacaattctaaaattcatatggaaccaagaaagaactgcatagccaaagcaagactaagcgaaagaacaaatctggaggcatcacactacctgatttcaaactatactataaggccacagtcaccaaaacagtatggtactggtataaaaataggcacatagaccagtggaacagaatagagaacctagaaataagcccaaatacttatagccaactgacctcaacaaagtaaacaaaaacataaagtggggaaaggacacccttttcaacaaatggtgctgggataattggctagccacatgtaagagaatgaaactggatcctcatctctcaccgtatacaaaaatcaactcaagatggattaaggacttaaacctgaaactataaaaattctagaaaataacattggaaaaacccttcttgacattggcttaggcaaggatttcatgaccaagaacccaaaagcaaatgcaataaaaacaaagataaatagttgggacctaattaaactaaagagcttttgcgtgtcaaaaggaacagtcagcagagtaaacaggcaacccagagagtgaaagaaagtcctcataatctatacatctgacagaggactaatatccagaatctacaacaaactcaaacaaatcagtaagaaaaaaaccaacaatcccatcaaaaagtgggctaaagacatgaatagacaattctcaaaagaagatatacaaatggccaacaaacatatgaaaaaatattcaacatcactagtgatcagggaaatgcaaatcaaaaccacaatgcgataccacctcactcctgcaagagtggccatgatcaaaaaatcaaaaaacagtatgtgttggcatggatgcggtgaccacggaacacttctacactgttggtgggaatgtaaactagtacagccactatggaaaacagtgtggagagtccttaaagaactaaaagtaaaactaccatttgatccagcaatcccactactgcatatctacccagaggaaaagaagtcactattcgaagaagatacatgcacacgcatgtttatagcagcacaattcacatttgtgaaattgtggaaacaacccaaatgcccatcaatcaacaagtgggtaaagaaactgtgtgatatatataaatatatttatatataatatataattatatatataattattttatttatattatatagttatatataattatatattatatattatataattatatataattatatatgtataatatataatatataataattacatataatcatatatgtataatatataatgtataataattatatataattatatatgtacaatatataatatataataattatatataatcatatatgtataacatataatatataataattataattatatataatataatatataataattataattatatataatataatatataataattataattatatataatataaaataattataattatatataatataatatataataattataattatatataatataatatataattaatggataataattaataattaatatataataataaataatagtataaatataatatataattatatatgatatagtatatataattatatatgatatagtatatataattatgtatgatatagtatatatcatatataataattatatatgatatagtatatagcatatataataattatatatgttatatatattatgtattatataatatgttatatataaatatattatataatgttatatataatatattatataatataatatataaaatatagataatattatataatatataatatatataaattacataatatataatatatataaattacataatatataatatatataaattacataatatataatatatataaattacataatatataatatatataaattatataatatataatatatataaattacataatatataatatatataaattacataatatataatgtatataaattacataatatataatatatataaattacataatatataatataatatatataatatataatttatatatataatatatatatgatggaataccactcagccataaaaaggaattaattagcagtatttgcagtgaccgagatgagattggagactattattctaagtgaagtaactcaggaatggaaaaccaaacatcgtatgttatcactgatacatgggagctaagctatgaggacgcaaaggcataagagtgatacaatgaactttggggacttggggggaaagagtgggagggggttgagggataaaagactacaaatatggtgtagtgtatactgtttgggtgatgggtgtaccaaaatctcataaatcactgctaaagaacttactcatgtaaccaaataccacctgtaccccaataacctatggaaaaaaaatagcctcggtatctcttataatcaaaatagatgtattagttttttattgctgctgtaacaaattaccaccaaatctgtggcctaaaaaatgtaaaattattatcttacagttcttggagtcagaagtccaaaatgggtctctctgggctaaaatcaatgggtttgtaaggttgtgtttcttttttgtttttgcctttgtatacatgtaaggggtacaactgcagtgttgctacatggatatactgcttagtggcgaagtctgggcttttagtgtaaccatcactcaaatagtgtatattgcatccattgagtatttctcatccctcaccccacttcctccctccctcctttctgagtcttcagtgactattattccacactcatgtccatgtatacacattatttacctcctgcttatgagtgagaacatgcagtatttgactttctgtttctgagttgtttcacttaagataacggcttccagttccatacatgttgttgcaaaatacatgatttcattcatttttatggctaaagagtattcatggtgtatatgcaccacattttctttgtccaataattcactgatagacccttaaattgattccacattttgctattgcgaatagtgctgtgataaacatacaagtgcaagtatcttttttatataattatttatttgtctttgggtggatactcagtagtgggactgctggatcaaatgttagttctatttttagttctttgaaaaatctccatactgttttccacagaggctgtactaacttacttgcccaccaacagtgcataagctttctcttttcctcacacccctgccaacacgttttttttctgtctttttagtaatagccattctgactggtgtaaaatgatctccttgtggttttaatttgtacttatctgatggctggtgatggtgaacattttttaatatgcttgttggccatttctgtgtaattcttttgaaaaccgttgattcatgtcctttgcccactttttaatagggttgttttgttgttgttgatgagttgatttccttataaattctggatatcagtctcctgccagatgcatagcttgcaaatcttttctcccattctgcttgttatctcctcatgctattgattatttcttttgctgtacagaaactttttaacttaattaagtcccatttgtcaatttttgttgttgtcgcttgtgcttttaaggactaagtcatgaattatttgtctagactaatgtccagaagagttttccctagtatttttatgtttcaggtcttacattgaagtctttaatccatcttgagttgatttctgtatatgatatgagatagggctctggtttcattcttctgcttatagtaatccaattttcccagcaccatttattgaaaaaggtgtccttaccccagtgtatatttttgccaactttgcaaaaggtccattgtctctagatatgtggcttatttctgagttgtctactctgttccatttatctatgtatctgtttttataccagtaccatgttgttttgtttactatataaacaaaataatattttaatttgtggtctggtcatataatttgaggtcaggtaatgcgatgcctccagctttgttctttttgcttagaattgctttggctattcaggctctctttttggttacacatgaattttaggattctttttcttaattctgtgaaaatgacattggtattttgatagggatttcattgaatctgtagattgctatgggtagtatggtcattttgatgatattaattcttctgatccataaacatgggatatttttccaattgtttgtgtcatctataatttctttcctcagcattgtgtagttttccttatagagatctttcatttccttggttaaatatattctcaggtattttattttttgtagctattgtaaatgggattgccttcttggtatggttctcagcttgatagttattggtgtatatatatgccactgaattttgtacattgactttgtaagctataactttactaaatttatttatcaaatttaagtcttttggaggagtctttaaggttttttaggtataagatcatattgtcagagataattgaacagagatgatttgacttcctcttttccaatttggatgccttttatttttttctcttgcttgattgttctggctaccatgctcttttctgaaggctgtagtgaagattccatttatttaccctttctaacttctaaaggctttccacattctttgttttttgtccccttactccatcatcaaagccagcaatgctggaccaagtctttctcacaacaccatctccctggttctattatgccctttgtttccacctgtaaggacccttttgattacactgagcccacccagataatcaagaataatcttccccatctccaggtcaggtggtcagtaaacttaattccatctgcaaccttcatccccctttgcaatgcaacctaacatattcacaggttccggacattaccaaatggacttctttgggagctaattattctgcctaccatgatagaattagaacaaggaatattatcaggtacaaagaagcataaagagtcaattctagaagaagatgtaacaatcctaaggatgtatgcattcaacaacatagcctcaaaatacttgaagcaagaaccaacagaactgaaaggagaaacagcaaatccacaattatagttgaggacttcaacactcttagtaatttgtagaacaagcaagccgaaaattcttaagaatagaaaatatctataacacattatcaaccaaactgactaaattgatatgtacagaacacgcctcccaacaacagcagactacatgtgtattttcacgtgcttatggaatattcagcaagatagagcatattctgggctacaaaacaagctttaaacttaaaagcatcgaaatcatagaaagtatattccagagtaacattagaaatgaattatagaaagatatttagaaaatctccaaatatttaaaaattaaaccatgcacttctaaataaccatgggtcaaaatgaagtctcaaaagaaactacaaaacatttcaacaaaatgaaaataaaggtataacatatcaatatttgtggaagaagataaagcaatgcttagagggaagcttacagcattaaatgcatatattagaaaagaagaaaggtttcaaattgataaactaagattccaccttaagatcagagtaaaaatagctaattaaacccaaggaaaataaaatttaaaagatgataactgcaagaatccatcaatatcatagaaaaacaatagagaaaaaccaatgaagctaaaagttaattctttaaaaaaaatcaataaaattgatagacctcttgcaagcaagagtgaccaagaaaaaacagaaaagacacaaattaccaacatctgtaatgaaagacaagatatcgatgtagatcccactggaattaaaaaagataataagggcatactacagataaatccatgtccataaatttaacaccttagatgaaatgaaacaaataactcacattatcaacgtctgctgaaaaaatttatatcctaaattgtcctatatctataaaaaatgaattcatagtttaaaattttccaataaaggaaaaactccagggctagatggattcactagtgaattttataaaacatttaaggaataaaaaataataattctacccattttctttcaaaagatagaagaggagagagcacttccaatcttactttctaaggtcaaaattacccttgtactaaaatcaaagacttacaggaaaagaaaattaaagaccaatatccctcataaacaaaaatataaaagcccttaacaaaataatagcagattgaatccagcaaattataaaaagaataatacaacatgattaagtgaggtttatcccagggagttgaggctggttcaacattcaaaaatcaatcaatttaccatattaatagactgcagaaaaaatagctgtgactgtgaccatctccatagattcacagaaagccctgcataaaatgcagcatctattcatgataaaactttacgtaaactagaaatataaggtaacttcatgaacccaataaagataatctgcaaaagtatccatagtcaacactataattaatgatgaatgactgaatgttatccccattaagatttgaaaaaaggcaaggatgtccactatcaccattcctattcatcattgtactgcaagtcctagcccataaaataaagtaaaagaagaaaaagaaaaagaagagcaaacagattaaaagaaatgaaataaaactgtctctacttccagatgacatgtttacatagaaaatcccaaagcatctaccaaaaatctcctagaactactaagtttcataaggctgatgagaaaagcactacatataaaaattaattgtacttccatgtactagtaatggtaattggaatttacagttttaaaagtatcatttacaaaagcataaaaaaatgaaaaaggtataagtaatgaaaaaggtaaaatataggtgcaggatccacaggttgaaaactacaaaacactagtaaaagaaatgaaagaaatcctaactaaatggattgatatcatatccatggtttgaaagacaatattgctaagatgtgaaatttccccaaattgatctatggattcaaagcaatcacaataaaaatctcaggaaatttttagtagacatagtagatataaaaaacaaattcaaaaatttatataggcagtctagggaactagaatagcaaatacatttttagaaaaagagaacaaagtcaaaaaactgacattatctgacatcaaaggcccatgtaacatatactaagatatactctgttttaggatacaaaagcaaaccccaacaaatttaaaagaattgaactcatatagtgagtgtgttttctgaccaaaatggagtcaagctagatgtatttccaggcacatggctcaagctgtcagtggatctaccattctggggtctggaggatgatggccctcttctcacaactccactaggcagtgtcccagcagggactttgtgtgggggctctcaccccacatttcccttctgcaccaccctagcagaggttctccatgagagccccacccctgcagcaaacttccgcctgggcatccaggcgttttcataaatcttctgaaatctaggtggaggttcccaaacctcaattcttgacttctgtgtacccgtaggctcaacaccatatggaagcttccaaggcttggtgcttgcaccatctaaagccacagcccgagctctatgttggcccctttcagccatggctggagcggctgggatgcagggcacaaagtccctaggctgcacacagctcagggaccctgggcccggcccacaaaaccacattttgctcctaggcctctggccctgtgattggtggggctgctgtgaaaacctctgacatgccctggagacattttgcccattgtcttggagattaacatttggctccttgtcacttatgcaaacttctgcagcctgcttgaatttctccccagaaaatgggattttcttttctatcgcattgtcaggctgcaaatttttcaaacttatgctttgtttcccttttaaaactgaatgcttttacacgcacccaagtcacctcttgaatgctttactacttagaaatttcgtcagccagataccctaaatcatctctctcaagtacaaagttccacaaatctctagggcaggggcaaatgctgccagtctctttgctaaaatgtaacaagagtcacctttactgcagttcccaataagttcctcatctccatctgagaccacctcaccctgaaccttattgtccatatcactactagcattttgggcaaagccattcaacaagtatctaagaagttccaaactttctcacattttcctgtctttttctgagccctccaaactgttccaaccactgcctgttacccagttccaaagtcacttccacatttttggatatcttttcagcaacactccactcctggtaccaaaagttgtattagtcaaggttctctagagggatggaactaatggaatatatatatatatatatatatatatatatatatatatatatatatatatatatatatacacacacacacacacataaaggggagtttattaagtattaactcacacgatcacaaggtcccacaataggccatctgcaggctgaggagcaaggagagccagttcaagttccaaaactaaagaacttgggggccgggcgtggtggctcacgcctgtaatcccagcactttgggaggccgaggcgggcggatcacgaggtcaggagatcgagaccatcccggctaacacggtgaaaccccgtctctactaaaaatacaaaaaattagccgggcgtagtggcgcgcgcctgtagtcccagctacttgggaggctgaggcaggagaatggcgtgaacccgggaggcggagcttgcagtgagccgagatcccgccactgcactccagcctgggcgacagagtgagactccgtctcaaaaaaaaaaaaaaaagaacttggagtccgatgttcaaggggcaggaagcatccagcaagggagaaagatgtaggctgggaggctaggccagtctcccttttcacatttttctgcctgcttatattctagctgtgctggcagctgattagattgtgcccacccagattaggttgggtctgcctttcccagcccgctgactcaaatgttaatctcctttgacaacaccctcacagacacccacaggatcaatactttgtatccttcaatccaatcaagttgacactcagtattaatcattacactagatatcagtaacagaaagataattttaaaaatctatgaatacacagaagctaaacaacacatttctaaatgggtctaaaaagaagtccatgggtcaaaaaaagaaatatcagggaaataaaaaatacactgaactgaatgaaaatgaaaatacaacatatcaaaatttgtgggaaatagctaaagaagaacttagagaaaactttttagcactaaatgcacatattggaaggaagggaaaagcttcaaatcaataacctatgctcccatcttaagaatacagaaaaaaagagcaaaataaacttcaagcaagcagaaggaaagaagtaataaagataaaagcagaaatcaatgaaattgatgacagaaaaacaatagaaagataaaaaaagaatgggatatttgcaaagatcaataaaattgacaaacctctagcaaggcagacaacaaaaagaaaagagagaaaacacaaatgaccaatatcacgaataaaacaagggatgtcatgagagaccctgaagacatcaaaatgatagtaagtatattacaaacaactctacgcatataaatttgataatatagacaaatagaccacattctttaaaaaccacaaactaccatgactcattcagtatgaaatagattggattagtctgttttcacgctgctgataaagacataaccaagactgctcaatttacaaaagaaagaggtttaatgaacttacagttccacatggctggggaagcctcacaatcatggtggaaggcaaggaggagcaagtcacgtcttacgtggatggtggcaggcaaagggagcgctcgtgcagggaaactcctgcttttaaaaccgtcagctctggtgagagacttattcactatcatgagaacagcatgggaaagacctgcccccatgattcaattacctcccactgggttctttctcacatgggaattgtgggagttacaattcaagatgagatttgggtgaggacacagccaaaccatattacagatgatgtaaatggctccatagctctttttttttttttctttttgagacagggtctcactctgtagcccaggctggagtacagtggtgcaatcatggctcactgcagccttggcttcctgggctcaggggatcctcctaattcagcctccccagtcactgggactacaggtgtgtgccaccatgctaggctaatttttgtattgtttgtaaagatgggttttcgccatgttgcccaggctggtctcgaactcctgggctcaagcgatccactcacctcagctttccaaagtgctaggattataggcatgagcgactgcacccagcctctataattattacataaactcaaatcaaaatttaaaagccccataaaagaactctccaggcccaaatagtttcactagaaaattctaccaaacatttaaagaattaacaccaattctacacaatctcttccagcaaataaaagaagaaaaacacattctaactttaagaagttagtattaccctgtgataagaaaacaagacaaagacattacaaggaaagaaaactatggaccaatatcctttatggccagaaatataagtccttaacaaaatcaaagtagattgaatgcagcaatacataaaaagaataatacaacatgactaaatggggagacagtgaacctataaaggggacagggaagaagagcgagagataagaaggaagaaaaatacagaagaacactatatcttataagctgttttaatcactttgtattgctataaaggaacacctgaggctgggtaatttgcaatatgaagcggtttatttggttcacagttctgcaggctgtacaagaagtgtggcaccagcacctgcttcttctgagggcctccgactgcttctgcttgtggctgaaggcaaagggaagaaggcatgacatgatgagagtggaagcaagaaagagaggaggaaggtgccagcctctttttaacaagcagttctcatgggaactaacagagtgagaaatcactcattaccatgtggtgacagcacctagccatttatgagggatctgcccccatgacccaaacacttccttttagggcccacctccaacattagggatcaaatttcaacatgaaatttgaggagaaaatatacccaaactatatcataagccaagggaaaaactgtttcagaagagaggcaatagtcaagttcattgactgttgcagaaaaatcaagcaagatgaaaaaggaaatatgtgcttaatgacaaggatgtaattgatgactttggtaagagtgttggggacagaagccagattgcagtgagaggggagtgagtggcagaggaggaattagagacactgaacgaaggtagacaactccttccagaagcacgtgaaagtaggagatagctcagtagcttcagaggcagttcaggtcaggatgagaggagggatatttaacacaggaagatttttggacatacttatatttaatttcttgtggggaagagagacagctcagagaaagagatgactcccatagatgacaaagaataactgatgaagagccaggtcctcaagaaggagaaggagttgaaatccacagtacaagtgaagaggttggctttagcctggagcaggagcccttattcccctatggaagaaagaacagcatggctttgagtcccggactatcttgggacttcgggcaagctatacaactttttcatacttaaacttctccatctgtaaagtgctaataaatatatctaacttctctttttccttctgctggtcaaaatgctccactcagtcctatcagattaagatcttgacttgcatatgaagcccagatcaaagtgagctgttaatattctgtccatgaagagccatccagtgcatgaccatggacaagctgtttaacccctcgaagccttagttttcacatttgtaaaatgggaatgatattagctcctacctcacaagattagtgtgaagattaagggacctaagacatgtaaagtacttagcataacagctaacctattgtgctcagcaaattgtaggcgtaacctataagccagaaagtcacttgaaattaagacatgtgttttgcgaccatgtgcagtggctcatgcctgtaatcccagcactttgggaggctgaggtgggcggaacacctgaggttgggagtttgagaccaacctgacaaatatggagaaaccctgtctatactaaaaatacaaaattagctgggcatggtggtgcatgcctgtaattccatctactcgggaagctgaggcaggataattgcttgaacccaggaggcagaggttgcggtgagccaagatcacgccattgtactccagcttgggcaacaagagcgaaactctgtctcaaaaaaaaaaaagtgtgttttgctcatctcagtgtatcttgcaggatctgtcttggagttgacattcaagatatttgctaaattgaactgcactgtacagagctaaaagaagtccagagatctaagctgttgtttaaggtcacacagtgggttagagtcacaactgggactagatgccacgtctgctgtttcctagtatagaaagggttctttctagtacattacacattagagggtgacatacacaccaatttccaagaacacaactgctgtgtagggcaatataaccataactaagtaaaggcccacttggtaggtagaatagaaaaagtcctttagttttagttgctgacagaacctcatagccaggccacttccacctgctgttttcccatttgatatttctatgatctaacagttttgaagttttccttcttagtcactcaaagtaaaataaaacattgtatttttctacatttgagttctgattcatctcacaattctctgtggctccaggctaatttaattgttaaaattagacccctgaggagttgagagagaccaacaatgatcaagttaaatgcacactacatgatcagtatttaattaggtattgttgcaaaattcatgttaattaccatgttggtattattacaaaatgatgattcactttttatatatctcagaggaaattaagctatgtatattgggacctatgtataaggttttaagtaaaaaccttaaataggttaaaaacccaaggaggcccttaaaaatgtgcctgattgatttttggcaaggtgcaaaatgaattcaatggagtaaggacagctttttcaacaaatggtgctggagcaattggacatctataggcaaaaaaatgaacatacaccaacacttcataccatatataaaaatcaactcaaaatagatcacgacgttaaatgtaaaacataaaactttaggaaaaaataagagaaaactcttgggattttggactaggcaaaaatttcatagatttgacaccagaagcatatctataaatggaaaagaaagtcaataaattgaacctgatcaaagtttaaaacttttgctttgcaaaagcccatatgaagaagattaaaagataagctgcaggctggaaaaaaatattttcaaaaccacatatctgacaaaggacttgtatctggcatatatgaagagctctcaaaactcaacaataaaacataataatccagttagaaaaagacaacaaaagacatttcaccaaaaaggatatacagaaggcagaaagcacatgcaaaaatgctcaacatcattagccatgagataatgcaaattctaaccttgatgagatatcattgcatgcctataagaatggctaaaataaaaagtagtaacaacaccaaatgttggtgaggatgcagagaaactggatcactccttcattactggtgggaatataaatggtatagccactctggaaaagtgtttggcaatttcttataaaactaagcatgcaactcccacacgacccagcaattgcactcttgggcatttatcccagagacatgaacatgtatgttcatacaaaaccctgtacatgaatgtttataaaagctttatttgtaatagccctaaactggaagcaacccagatgtccttcaatggctgactggataaacaaactgatatacagtcctactatgggattctactcaccaaaaacaagaaataaacttacaatacatgcaacaacctgaatgaatctacaaagatttatgccgagtaaaaaagccaaacatgaaaacttacatactgtatgattccatttatataacattcttgaaatgtcaacattgtagagatgaagagaaggttagtgtttgacatagattaggaatgggaccagagtgtggatgctggagagaggtgggtgtggttataaagggcaacagaagggttcctggtgacaataatgaaagaactgctcagtgtcttgatggtcatcattaataattatccagggcataaaatgttacagaatttaacatgtacacacacacacacacacacacaaacgcgtgcacaagtaaaactgaaaaatgtgaataagatcagtggactgatctactctataatggggaaactacatatggggaaattgggcaaagtgtacaagggattgctgtataatttcttacaactgcatgttaatctacattgacctcattaaaaaataaaattgaaggaggcattaaagacacaacagtcagttgtgagaaacatgactttaaggcttttaaaaggaaatagaggtgaatgtcttcatgacctcaggataaggaaagatttcttttagaaacataagtagcacaaaccataaagttaatgattaatacatgtaactacattcaaacaaaaattctgtgcaacaaatagcatttcaaacgtgaaaagacaagccacagagtgctagaagatatgtgcagtacaggatttaacaaaggatcggtatccagaatatagaccaataaactacaaaacaatctatttttttaaaaaaatgggcaaaagacacaaacatgcgattcctcaaagaggaaccctgagcaatgtacatgtaaaaagtttatgaactatcctagatacctgagaaatgcccactaaagcacaagaaaccatttcacacccaccagattggcaaaaactttattattattttgagacagtgtctccctctgttgcccaggctggagtgcaatggcagagatcacagctatctgcaggctcaacctcctgggcccaggtgatcctcccacttcagcctctcgagtagctgtgactacaggcatgcgccaccaagcccagctaagtcttttgtatttttttgtagagatggggttacaccatgttgcccaggctggtcctgaactcctgagttcaagtgatcctcctgctttggcctcctaaaatgctggaattacaggcgtgagccaacacgcccagcagggcaaaaattttaaaggtctgaaaataccaggtgctggcaaggaagtgggacaactggggctcccatacactgctggtagtgtgtaatttagtagaaacacttcaaaactctatttggcaacaaccagtaaaatggaagatgcatatattttgtgacccaacaattttatttctagatgtataacctagatcgcagcttaaaatcgttttggttcatgagtcatagtatgaaattcattttacattgtagcctaatatatatatatttatagttgaagcaaaaatgttctataagaatttttatcctgcatgaaaagctttctgatattttctattccatttttttttaactactaaattgatctcatgatatactaatgcagtgtttctcaactttggctgcatattacaatcgtctgggggagctattaaatttccattgctgaggtcacaacccaaacaaattaagttagaatatctcagggggtgaccccagcatcagtagtttttgaagttccccagatggttccaatgtgtagccaaagttgggaatcactgcaataatgggccacaacgtgaactttggaaatcaatgccctaactgctgaaattctaataaagtctttaagttagtaatagtagtgtgccaatgttaattttttggttttgattattgtactatagttatgtgatattaatattagaggaaactgagtgaacattatataggaactctgtacagtttttgcaacttttctgtaagtccaaaattatttcaaaaaaaagttttttaaaaagaagaaagaactgccctagagaaattattgcacgaagagatgtgaataagaatattcacagcaacacttgtttgtaagttcagaaaactagaaacactaaaaagtccatcaagaggagaatatataatacattgtggtacattcctacaatggaatactatacagtagttaaaatacatgaactaaaagtatatatgtctacatggatggatcttaagagcagataatgagtgacataaagcaagttgcagaagggtaatttatagcatgatactattttgtgaggcttaaaaacacttaaaataatattacatattttatggacacataaattttgagtaaaagtatggagaaatgcatgggaatgaagaccactaaattcagaatagtgattactttggggaggaggcaggaaaatgaaatcagagttgggtggatgagagacttcaactgcatttgtactgtttcattacaaaagctgagcagtgggtatgtaagctttggttgcattactctttttttgctcatttgtatgtctaacatatttcataatttaaaaattaatctgatcataacaaatgccccacactggttggggatgttgactgtgggagaggctatgcatgtacaggggcagggagtatatgggctatctctgtatcttcctctccattttgctgtgaacctaagagtgctctaaaattagccttttttttttttttaacataagccaaaggactggtaaatcatcaggtgggatagaaaagagaacggttgtagagaagctgagtttgggagcaagtaagcggcagtagcatgccattgctgctgtctacccaaccaggtcatctgccagtgtacttgactgccaatgtgtatagaaaaggactatgccatgtgaatgccaagcccttggggctagcatttcattagtaacttgaagagaagtaagctcagatgacagcccactttcttttcttttctttctttctcttttttttttttttttagacagagtctcgctctgtcaccaggatggagtgcagtggcgcaatctcagctcactgcaacctccacctcccaggatcaggcaattctcctgcctcagcctcccgagtagctgggactacaggcacgcactaccatgcccagctaattttttgtatttttagtagagatggggtttcaccatgttggccaagatggtctcgatctcttgacttcgtgatccgcctgcctcagcctcccaaagtgctaggattacaggcatgagccactgtgcccggccgacagcccagtttctctgatctcaccttaaactcctccatgttggtattctctcgaggtagggctgagaatagaaaacaaagccctgggaacaaggtcaatcaaccacaaacacttctctagtacagcccaaattctggacactacagctggaatagagaagtaggaggaagaaaggtggtgaaagatgggctagagacactccttctcctttaaagaagaatcaggctctgttagagctgtgagccatcagacctttgccatgaccattctcaggtgtgatcacaatgctgacctccactgcctacccaaagccattcaccatcccacagaggaatacatggaggaggtgaaggagttaatttaggatccaggacagctttgaagaggtaggtcaggcagcaatcaagggctgtgggcacctaagaccagcaggagggtgctatgtgcctagggtactgcaaaagacaataaagaaaggaaggtgggagacaccaaagacaaaccccacatatttcctaatttaggatcaggccccgtcctgtctcccatactttctcccagataccagatggaaaatgcctcccgagcgggaagagaatatgttggctcctactccatcttcctctggtagagttccagggtctaggggtggaagggtacaatgccagcaccattcatccttctctcgtgccacacggaagagcttctctcttttcctcttgccccgtacctccgcttaagaaggaaaaacccattcttcatgcctgctggtgggaaaggctctgtgggaatgcctacctacagaaacttgaggttattctcatacatgaggccattatctgaatcctccacagcaaatgtgaatcccagatgattatcaccttgctcagggcacaacactaactgtagagagatcaaagacagagacgagtgggaggactggaaagggatttagaagattgagtttacgaggtttggctactgataaggggatgaagagaaggttgttaaagatgggaattggtgaaggatttgctaagtgcttggcaaggcaatgggtgccattccctgagatgctacatagtcgaagagaagtaggttgggtgggacaggatgatggcgattgaggagtgtgggggacaactgagtggagatacctaaaaggcaggtggcttttcacgtctggcattcaaaggagaggtctgggctggaggcatgtatttgggcattatggcataaagatggtgactggggagtagacaagatggcctaggatagactggagagaaacaacaggactgacccactgaagacagaaccacttagtaaacacaaaattgggtaacttgtttaatgctcaccttgctgcttctctgtgatagttctttgaaaaaaaaaaaaaaaactttgaaaaaacaccagtattccagtagaaaatcaacatatttgatgtaatttctaatatgacatctttgctaccacaactgctatacattttgcacaaattcaggcaggggaacttactggagacaaattaagccaaaaagaatttgtgaggaagacacttttctttgatgagatgaaatttgttccctaaaccactttgaaaagctctttatctcatttatcaagatcaagctttttagacaaaaacctattttggtcaagtctttagacactggattggaaaactgaagagaataatcagacagtaatttccttggtcctagttgaaaaattgtgataagctgagtagaggtgctttggccaaccatatacagagcataattttatgtctaagctgctgatgacagtgcatatttcccataataggcactctagctgcacagaataatgaactgagaggaggtgagaggctgttgatggacttactaaaaccttagcaatggccaagtgatactgattagggaacatcaagagtccatatgattaagtctttagcattctaagttccttagaacagcccctccatgtcagcactgaattttagttccccttgtaagtgacaagaatgcattaagaggtttgtgtaaatcagaaaagctcccttctctccgagaggctctggtgctatagcgatgaatcattgagatgaggatacttgatgcagtccctgtaccaagaaagttgcttggaatcctttgtaaaagaaagccttcatcaccagccttttttccttccttccatttctagaatctacctggtaaaaagagacagaaatgaccactgagatggaggcctgctttacctgctctattggttttctagggctacttgtaattaagtaccacatactgggtgatttaaacaacagaaatgtattgtctcacagttttggaggtaataagttggaaatcaaggtctccagagggttggttccttcagaaggctgcaagggaaccatctgttccaggcctctctctcctgggcttgtagatggccatcttctacctgtgtgttcacatggcagtcttcccgtgcatatgtctgtctctgtgtgcagattttctccttctataaggacaccagtcatagtggattacagcccaccctaataccctcattttaacctgattatctctataaagacactatctccaaataaactaacattctgagctgagtcacctactgtggttaggactccaatttatcttttttggggggaatacaattcagcccataacacccgccaagcacataatctggtccctgggaaaagcaccattcccgcattgggcagcctattactggtaagaaactttgaggcttggacctatggactttcagggctgcaagggctcctagaaaccatctggtcccacaaaggactggtccaaattcacaaggcagtgccttagttgagactcagtccttagaggtgccagaagccctaggcagaggccatggggaagacagcaagataagtatcttttccaagctgttgtgcctccccccatgtcctccttcccaccctcatcccatttctaggtatccgtgaggcctgacagtgagtccaactgaaatgggttatttcacctatccaagcagattttaaagccatttcaaaagtaaaggaaagaagccagaagtggaaaataaagtgaagtgactcagttacaatcatgacattattttctgatccatttttgcataaagattttaatgacttccgtttcagctgatccattaggagcttttaaacttcccctgatggtagagtacatgagtacagccctgtgttctattggcacttgaaataatgtactgatttcaaaataccaccttggcagaaatcaactgacaatacttaaatcaaaacttctcatgaattgtggctgattagagcacttaccctcaaattacttcaagtccacgtgaaattagaaaaaaagttgaacccattttcaagatcattgatatctggaagatattaaagtatttcagagtacttcactgatttccaaactagtgctaggaaacttcattacaacagctcaagaggaggcgggatgcgtgcatgggctaggaccccctaggtgacactgcataacgtcacttctcttagaccacttcccaatctataaaatgaggggacaagactggtcaatctcagatgccatcaggctctaaaattgctactatcttgtggggttttttttgtcaggtttaagaatactgtaatcaagacaagtggtcctcaaatttttgtgttcatagcctattttgattattacagtttttttgtagcacacgctaggggactaaaagacacaaaacaatagcaaacaagcaagcaaaaattacaacacacgaaagctcagtataacaaagtctctctctgtctataaaagaattcctagtcatcgctgtaggcacctggttgctctttagccatgaatcactgtgagaaccgttgggttccctaaccagagtcgcccctcagtatccatgggggattgttccaggactccccctaggataccaaaatccatggatgctcaagtcctttctatataatggcatcatatttgcatataacctatctacatcctctcatataatgtaaatcttttccagattacttaaaatacctaatacaatgtaaatgctatgtaaatagttatgctgaattgtttagggaataatgacaaccatacaagtctgtacatgttcagtaaagaggcaaccatccattttttaagaatattttctagtcacagttggttgaatccacagatgcagaacccacgtatacaaagggccgactgtacttaggaagcaaaggtcttgcatgtaccacaaaccactctgtctttctttggttcatgtctgatgttacactccacatgccttaccttttctttgaagcaaattatattccccattccaacctcgttcattcaggtgcaaggggaagagaaaatcagaacagtaacaggagatggggtggagtggctgaaagatgatataggacttctggctgaactttaagctaaagttttgtgcagaagagtgacatgatgtaaatcttactcttcaaacatcactctggcaactgtgcagagaaaagactgaatggggcaaggcagaagcaggaagagtagccaggaggctcctggagtgattcaagcgagagatggtagggatgactagaactggagtggaagcaggagtggtagtgagaagtggatctatgtatctagaaggaaacatagacagaattcattgatggattgaatttggggtatgagaaagagaggtcaaattaaactgcaagattttagcctgaacaacctctacttactgagatgtggaagtctgcagatggagcaaattcaggggagcagatgagggatttgatttgagatgtctattgcatacccagtggctgtgcataattcacagctgggtgtacaagtctagggctcatggtagaggcctgggctggagatgtatgtttgggagcagtacatacatggttttgaaagccatgatattaaataagattagaaaggcaacgagtatagtgagagaagggagaatgcctaaggaatgaaccatatggctctctaaccttcagattagatggggaggaactgtcagaagtgagggcaaaggagcagccagcgtagtaagaggaaaaccagaagaatacggagccctggaagctgagagaacaaaacacaaccacaacttgcttatttcaagagtttttctgatatatactgccagaacagagcatatgactaaattgtgggggaaaagaatcttgtgcaatgaacaaaatctggtggcacaactgtcctgcttaactacaatactgcctgctgtgatccaagccagggatgctgaccctggctctttctcgccaccaagccctcaaagcagcattataaggagaaaagttgagcagggatttcagtcagccagaccttggtccaaacctcagctctgccacatactggctgtgtaatcttggacaagctgcttcagttctctgacccttaatttcttcacttttaaatgggctatacctctgagggtactggaagagtaaaaatgatcacgtgtgcacatataatttggcacaaagtaacagttcagagtaccaaatattattagctactatctctctcaagaaataataaaagttaatctattatctgagaaatcagttgtgctgcctttatatccccaaagctcagagaaaaatctatctaatctacaaacttgaattctaagatacacatgatttcccagtatgactacccagcccccactgcttctcattcctacctccccccaccccacaatcgagctttaccttgtccacactggtctaacttccatttaatgctgtaacctgaatcccagtcacattcacagaaatggccatttgccagccctgatcctcgtggctctcgaaacatcatttgacactgtcgatcatgccctttttcttgaagccacacactctgatcctcatcccttttggtcttcttcctggactcctctccttcacctgcctcttaaagcctggactcctggggctctgttctgagtcctgttctcctttcacagtctacacagttacccaggggagctcatgaatgccatgcttcacctctgcaccaaggtaatggcttttccctccaaaatctatactaggcttcctgagctccagaccaggataaccaaatacctattgggcatcttcttgccctctcaatatgctgacaagtacctcaggtttaatgaaggtctaaagcagaatccattgtctccttcgtcctccaaaatcacctgctcctccctcagtcatcagtctcagtcgctcacaccaaaaaccgtaagtccctcctttccttcactcccaaaatgtagtcgatcccacagcaagcattgctaagtgctgccttcaaaacatatatatcaagatatccatgcctctctacgatagaggggcctgctccttggtatagtatatagttgttatctctggaccgtgaaactagacataattttaactttgtatttttgcatatttctatttctaaaaatttcctccacaaactatctactctttctgtaaatctttgctattcaaagtgtggtcccagatcagcagtatctgcattacctgggagcttcaggcctgactccaaacctactgaattggcattttaaccagatttccttgcgatttttatgaatgcccacttggagaagcactggtctagtttcctgccactccctggctccctccttattctcatctacctccccgtgacttcctcacacatcctaggatgcctctctcctctatgtttttgcttatgccatcacctctacctgcaatctcacagcctctcccattcttgtcttctgccttcaagattcatctcaggaaaataaacactgggggaaaatatcaggtttatgacaggcaaaatgttaatacttttaatatataaagatcttaaaatcaatgcaaaaagactataccctgaccaaaggtatagactagagaaggaaaagaaagtggtcagtagacatttgaaaatcaatgtaaacttcactaaaaatcaaagaaaaacactgaatacatatagtgtagaatggtggttagcaggagcagggtgcaggggcacaaaggatatgggaagacaaaagtcaaagggcacaaagttgcagttctgtgggctgagtctggagatctaatgtacaacatggggactagagttactaatgtcatatcgtatacttgaaatttgcccagagagtagatgtttttgtactcttgccacaaaaaaaggaaaggtaactatataagatgatggttatgttaatttgcttgtctgtagtaatcacttcaatatatatttgtatatcaagacatcatgtacaccatcatgtacagcctaaatatatacaataagaaagatttattactaaaagaaaaaatcaaagaaatgcaaaatacagtaaaattacatttgttatctattgctgcatagcaaattagcccaaaactgagtggcttacagaaacaataaataatgattatttcatattttctgtgggtcgctcagtcaagatgtctactgagctacagtcatcttaaggcttaaatgaagctggagcatccgcttcaaggtggcttactcctatggctggcaaattggtgctggctgttgccaggagtcctcaggtccataccacatagactcccgcagggctgcctgagtgtcctcatggcatggtgttggcttctctcagaacaagtaacccaagagagccaggaagaagaggcacataccagtaagtcacttctgtgataccccaggcacagaaaggcaaataccacatgatctcactcataagtaaaacctaaaaagaaagtggaactcctagaagcagagaatagaatggtggttaccaggggctgagggttaggcagggggggatgaggtgatattggccaaaagatacagaatttcagttagacaagtggaataaattcaagagattattgtacatcatgtgattatagttaatagcaatgtactgtattcttgaaaattgctaagagagtcgatttgaagttttctcaccacaaaaaaatgatgtgtgtgaggttatgcatatgttaattagcttgatttagcaattccacaatgtatacatatttcaaaacatgttgtacaccaaaaatatatacgatttttatttgtatattaaaacataaagagaaaaaaaagaacagatatttattcattctgttagattttttaaaaggaagcaacaaatcagttgtttactatatgagtgacttaatgacatttttaaagcatttgtgcctatagagagataaatgatagagagactgaaaggatgcacttcaaatataagcagtggttgtctctggtgctggcatcacaacgttttatttttcgtttttggaagtagtcattgctttgtaccattgcagaaatacatgtcctctgatggaaaaaaaaaaaaaagggggggggggtgtatttttaatttttacaaaagacagcccaggcatcattctgccccagaagcttcccttaacccctgattttgctgctgttgccctgaagcctgggttagctgctttctcttcttcttctttcttctttcttttttcttcttctccttctccttcctcttcctcctcctccttctcctcttcttcttcctcttcctcctcctcctcttcttcttcctcctcctcctcttcttcctcctccccctccttctcctcccccccactcctcctcttcttcttttctttttttttttttttctttttttggtttgagacagggtctggctttgtcacccaggcaggagtgtagtggcacgatcttggcttactgcagtctccgcctcctgggctcaagtggtcctcatacctcagcctcctgagtagctgggactacaggtgcgcgcaaccatgcccggctaatttttgtactttttgtagagatggggtttcgccacattgcccaggctggtctcaagctcctgagctcaagtgacccgctcgcctcagactcccaaagtgctgggattacaggtgtcagccaccatgcccagctagcagctttcttcttatgcccctaaagtacctcatccatccctcctttggtgcacttttcaagtggtattagcctgtcaatctatgcctctgtccttccgcccctcactagacacacatagtgccatgcttatccatctccaggtccctgatgccatgtgcagagcctggtcaacaacagacacttggtgtaatttgttgaactgaagtgaatagcactgctcacctagagccaagccagatggtatgtggggttgggttccattatgactgtgcatggctgatctggaaagaggagggcattgcagatggtgtggggtaggtcagctgtactcctggcccagaccctggtaccttcctttgcaatggctccagaactgggggagcccattgcacagcacctatagtggttctcttagccagagaactgaactggtggtgtgttattaattctgtagtttagtttcaagacagtagactgaccggcaaagttaacctgagctttattttgatagcctttaattctgtcccaggtttcatcaattaaacgatggcaggccaagcacttgagttgaaggagagatcaactaaattgaattaatgtctcagaaatgcactaaaaatagcacatgatccagtatcccagctggctccattatcaccacctatacagagcagataatgccatatacacaggctctgaaatatgactgcccagctctgccaaagcttctccattccaaatgctgtgagcaatttaatcaagttataaatgcttttttcttactgaaaaaaaagtgggacattttaattgggtcttgaattatgtttatattacaaaattggaaatttattattaatgaggagggatattcccagcttctaagcttcctttctagaataaatgtcactaaattaatcaaagacaaaaggaccactgattattcatacctaggattcaattctgactgggtccacattaatgtcagagcagggaagtttttaacatcagaaatgtgaagctggctaatgatagcgatacccttcaatggccagcttgggagcccaccttggggtacgtgggcctggcttggaaggcccagcccaactgtagttctggtttggccagctgactcaggcctgtcctgagccagctgagaagctccatgccctcctttaccaggtaagtttgcaatggactaatcttttttccaagctcgtcaaggtgatgagcttcccagaaagagactcaggggttgcaggtgggattggtgggtgtgagagagtatccctgaagccccaatacatgtgtgcatgcacgcacatacaaacaggcatgtgtgcatgcatttcagccagggtagctgtgctcactaaactttcccataacaaccctccacgttatggggtttttttgttttttgtttttttggtgacagggtcatgctctgtcacccaggctagagtgtagtggcaagatctcagctcactgcaacctctgcctccagagctcaagcgatcctcccacttcagcctcccaagtagctggaactacaggcgtgtgccaccacacccagctaattttttgttatttgttgtggtagagacagggttttaccatgttgcccaggctggtctcgaactcccaggctcaggcaatcctcccacctcggcctcccctcccaaaatgctgcattaagtttgttaggaaaagaggttctcttcaaaaggagagaaaacaatagttgagaaacttctagattcatcaggctctaagattatgtgatctcttctgcagctttgttggttccagctttgttgataagaagtcagtgaacatacagccatctaataagaatttgggaagcagctgttttttgtttggttttgattttgattttgatttttggtcttgttttcccaattgccaaatgcctccaaggtgccttcgtacagaaccaaaacaaactgctcaggtaaatgacagcctggcactttcatatttctgattcatttgatgttagtcatatttttccccattgggaagatccatatttttgtgacaagagcttcatattaattttaaaagtagattcagtgatgtcataatttctcattttgttaagtcctgaagcagtcattccccgtagagaagggggatgcatttcaccagataattactgttgtttattatggaggcaggaagaacaataatatcttcttttttagcatatgcccctagttcataaaggagatgaataaaagattaaggaataatgagggggtagtcgttattatattatgaatcattcttttatttactgtttgcaggtacttggtaggaaagaatgttatactcggaaagatgagaaggccttcctgagacttttgcagctaatccctaatattcagcagcagttatgtattgacggcctggggtggcagtgaggttcacttctcaaatgcactagatgaagaaccaatgtcaggcctgctggaactcagtcgctatgtagaagaaaatacatgcaaggaaagcataggggctgacagctagaagacacagatgggaggaaagtttggaacattttcttggggagaaacattttctgtggacacagaaaatgttgggtttcttttagagtttgcttgaggaatgaccaatggaaatgataaagaggtttctgctgtaccatctgagtgtcgggcctggtaaagtgatgtgacttggatctgtctgtctattcccaggcctgtggtgaataagcattgtcagcaaacagcttgggaggtaattgtgctctggttggaagggtaatgaaatgggcgcagactcaaaggtagttgtattagaggctcatattcttagattgcagttgttttctgaagaatgtagccgttgagtgaaagctgtcatctcaaaaagtggactatgctagcactgacaaaggattttcattttgtttgggtacttttcaagaatccattttaaaataagaaccattaatcagcaaatagaattaataatctaaataaaggcaccttgaattcacccttgcagcatacaaagcaactcccacgtgtcatctggctgaactttgtacaaatccatgtgcaacacgtgggtgttatctccattcacccatgaggactgtaaaggacagagtgcttttagccaaaagcatcctttggaacctatgacactgtatacttcccctaatgttaatgcttttccatcagacacaccccttgaaaatggaaaaaaataaaagtggcagatgcagggatggggagagactgtcggggttatggggcagttaggaagggaatggcaatatatttcagcagatccgctttgatggctttctggaaaaataaaacaaaaaggctacttggacatcccctgaaacctacttcgactagaagaccccagtgaaatgctcacttggcccatacacaactcagaaaacaaaaccacaatgtccacattagtgaatgcaggctccaagtttcccctagttcaaagccaactttcccaaattcatgaaaaggcatcccgaatccctcccatggctcttccttccacccctgtccgtcatgcaggtgtccattcattcagccattcttcctgtccctaatcctgcaggtgtgcattcagcaaacattcgttgccttctactgtgtggttcccaactgccaagaagtttctaactataaaataaaaaatgtttgacaaaatgacaacttaattcaggatattgtttctactcaggaaactccaccatcctgccacaccttactacccaactttaccctcccctagtctcccaccattcaggctggctgggctccttcctattccttcaatatgccaggacccatgcattgctaaataaataaagagtcctttagggtatcctccccatcccaacaccaccaagcaaccttctctgtcagagaatcacacccatgcattagggagctcaatgccacccaagccagctggtaccaccaccgggcatctcagagaatcagtgtttcttcagattgagccaaaatccgccttccctgcaccatttatacaactcggggcacaaagatgccagttttcaatgctgctgtaaacaagaatgtttgggcaccgaaagaaatatggcagctttctcccatctaactccacacccagaataacttgttaaagacgtgagcaaggggtaattttcttcatttgttttcttttttctttttttgttctctttcttttcctttctgtataaatcacatttaaattacctgctggggaggaatataaatgagactcagtcagacctcatgagtcatcttgcagagggaaacaaagcagccttgcttcaaaaagcaatttaattaactttgttatgtgctgtggaaataagcttttaaagatgaatcgaaacagctgcatgcaattgtttaaaaaataagtgaacagtgcaaattactgtctggtttttaggtatgaaaatagtagaagaaatgaaagattttaaaatgtgaaataacgtgaagtttgcattcaatattaaagaagacaaaaacaaaatgggctcttagctgagtatacgtcaaagaaaaacaaaagcaaacatgtcatcctttaaagacaatgctcttccgtagggacagccctgttctgacctaggatgagaggacacaaagttccagtctagcctttgaccgtcccctctgtgtcccagtgttttcatctgtcaaatgcagatgaatccagttttacctgtttcccagagttgaaggtcaaatggaatagtggatatgaaagcacgttgtaaactgcaaaacactgaacccatatatgacatcgttcttgctgatgaataactccatttcttcagaatagaaaaaaaaccactaggagttatagctcttttaaacataaacactcaacttactcttcctccctcaatattatacatgttgaaacacaaagaactggtgtatcacttttgtgaactatgaatggtaaacagccacatgaataggccatagttcatctcattgttcctcacctgggagggaagttggttgttcttctatggtttccctcatgcccaagcagaatgttcactgcagcacagtttgtagtgtcacttctcgctgttggtaaggaagctttctgatagtacaggtttgatcttgtccctctcctgctgaaaacctttcactggctccctgttgtctactttcctgccccgtagccctgcacttctgccctgtcctctctctccttgcagctctgctctggccattttgaagtcccttcccttttggccaagcacagcgtccacagggttctctgtatcctggtcctgttgcctccccaaccccagtccttctcaccctttcctaccccggtatcacacctcctcctctgccctggacctgaaatgccctttcccagatcctaccccacccctacctcccactgccaactccattactttctccaagcaactaagtgtcatatcacctataaagcttttagtgaacttcctctgatcctagggaaattgattcctgtgtgccccccatagaattgactcccatctgcctaccacctgcagacatcaattggaacccctcaaaaaaggcagtatccccatttacttgccattttccctctccagtctgggagctattcatgttcaggcaccatgtctttcatgcctctctgtacccccagcacatggcacatggaatatactcactaaatatttcacaaattagtatctggatgaatgaataaaaagtctgacctctacagcatcagccccagaaaaatgaattcaagaattacgcagactggggtgagactgatggaattcaatctaatcaactcctccccatggatactgaaaccagtaagtactgctatttataacctccaaagttttactttagttggatgattcaaccaattattgaattgccctaagttttcttaaaattcatttagaactattctgaaacatagtcaacttatttatctttagttcaggcatgcttcttgtgaaagtatgtaaacttcttgagaaaacaaaatccctatctactaggaaatgaatttatgaaaaggatgaacagacaataactagtagcctagcctagggatccaagagttaatgttacctcccaaaagtgttaattggctccttattcagcaggatccaaggatccattctaatcacacattagtgattttgtttctaccaactctggggaaaagcctttcttagtactttatgccacagcagaagtccatgtgtggtgttccatgaagttgtaacattaaatttgtttgtgtatcttgtagaaatcaaccttgctgacttataagcacaaatctaaaagcatctcatttactgaggaccaagaagggacatataagtaaagttttaaaatatcttaatttactccctttaaatctacgggcttatacagtcagaccatttgtgatagcaatgcttttaaatatgttgtacatttcgtaagcagatgagacagaatatcatttaacattctcctgaacactcaacattatccccaagaactctgatgccaagggagataccaagagataccaagagagctggtctgggagttggagaactaagttgtcatcctggctttttcatgacttgatgtgtgaccctcagcaagctacttctgccttctgggtctcatcgatacaatgaagagtgagactagatgattttgagatggtttcttccaattgtgtgaggtatttatcaagttttcaagtacatgtaatgttatgttactattttccaaagggaatataagcacttacatccagtgtcttctagaatttggtaggctagagaagcatagattaaacacaagagacagctattattaaatattgccatgacatataatttaataagactagggtatgttaaaataataagcaaactgcgtataattacctggccatatttttcagacccaaactcctagattttttttccctgtgatgtactcatttggtaagtggaaaaaaataacttcaacacttctgtcactccaagtatctacttctacaagtagagactacaattaatatatatgtccataaagaaatctatttccaaaaactacatatgaagacagttccagagtgcaaaacaagttccctaagccccttccaattatggaggcaatgacaattaacaactgatttggtggaaaattactttgtgcattcaaagcctgaaatactgccaaaatgggagagaatcaacaaaataacatagccaggctagattgaatccacaggaaatattatagaagaggcacttaatgagctgggcaaaggatgctgcttgctcaccaggtgaggttaatacaagaccctttgcccaagctttccatgacaatgcattgctaattttctcaagaaaaatctgctccagtggtgagtcactgcccttttactggcattattttaatgatatgagatagaagaaaaggtcacaatttagatcaatgccatctttggatgacggaataggtgagtcatcaaatgaaattaacactgaagcatcgttgccatttttgccgtctatactctctcctaatactctctacaaaaaaaaaaattcaatgagatatttcaggagagctggttgctaggtttcagcctcattcaaagctcttcatttcagcatggacaagaaacatggaaaattttcacgataacgatattaaatgtatcatgaggcagtcaaagggctcagatgtctatatgttgacagtggtaactctagcgactgacataaaatacaaaaacaaaagaaactcagccgcaagaactttagaaatcatcttagtccttccctttactttacagaagacaccaagattcagaaaggaaagtgacttgcctaaaagatcacacacttagaggcaagatgagacgagaagccaggtcctccatctccttaatcaatgtgcttcccaaacatcaggcatttttgattcatatatttcatttcagactttagattttacaaaatgtttcttattactggtaacgggaaacagcaaccaaaacaaagaagatgacttttttaaaagatttgaaaagattgtcagttttttaaaagtcttgattaaaatatttgttattaaaatgcgctgtaacacccctctagagaacatatacagatggaaacaagcacaggaaaagatactccacatcatatattatcagggaattttaaattaaaacaacgagataccactacacacctattagaatggccaaaatccagaactctgacagcaccaaatactggtgagggtatgggggcaagaggagttcccattcattgctggtaggaatgcaaaatggtacagccagtctgaaagacagtttggtggtttcttataaaactcaacatactcctaccatacgatccagcaatcttgctccttgatatttatcgaaatgagttaagaacttatgtccacacaagaaccggtacacgaatgcttatcctagctttattcataattgccaaaacttggatgccatcaagatgtacttcagcaggtgaatggataaattgtggtacatccagacagtggagtattattcagcaataaaaataaatgtgctattaagccacaaaaagacatggaagaagcataaacgcatactgctaagtgaaagaagccagtctggaaaggctacatattgtaagattccaacaatatgacattctggaaaaaggcaaaactatgtaaacagtaaaaagatcagtggttgctagggacttgggtggaggaaggaatgaatgggtaaagcacaggagaattttaaggcagtgtaactattctgtgtgatatactataatggtggatacatgtgattatacatttgtcaaaaatgtacaacaccaagaatgaaccctaatgtatactatggaatttaggtgataaagatgtgtcagtgttaggttcatgttgatggtggggatggctgggggtgtgggagcaggtgaggaggacatatggaaactctgtactttctgcttaattttgctataaacttaaaactcctctaaaatataaagtacatgttttttttaaatgctgtcgttttcttttaggatgttttacaactcaaagattttggattaggaagtacaacacagcccactgggctagcttacaagggaaagcctgatagctgctaagaaaatccactaaacattctttagaatatgaaagataatcactttatcccaaagaagttaaagagaagatctcatgaaatgcacttaaaaaaatgcatatttatttttatttattcatttttttaaaaaaaacaaaaacctacattctggctgctataacacacattgcatatttataatgaaaatgaaaaaaattaaatattcaacataccaatgtttactttgttcaaatgattatatgtattttattatgtggtcagagttcagcaagcttgttccttgagttcaatgtgacaagcaaaacatctgttatgtctagctagaagggtcctcctaaaacagccaccccaatggtctatgcttggattatagataatcataacattaaatgaaggttattataaagagtcattattagtaacaataatcgaagctaaatgaaacagataacaatcaacattaaaatgatcacttgatattgtggaacagctacagattaaacttttaaaaaccactgcattaacagaaagaacatatatcttctaaaatgaaaactatatcgacttctgagatataaataactgtgtgatcaaatgacattagttatgaagaatgtgcattatgtagaaaacattgcgttgaggacagagatggggtctagttctggaggtcattcaccgctagtagtcccctacgtgtcaggcccagctgcctcagaggcttaagagaacagaacacatattaatatgaaactaaatagaaagatttctaaaaagggacataatacggaatgacatccattcattcaccacatgccttagacacctattctgtgccaggcattgggcagagtgggagaaagatgtattgacatggtgcctaactgcatggaaatgcatggacctctagaattcacccaggcagaaatgggagtaggggttgagaaccgtttcataaggttccctctcaaactcttcagcgcaccattgtgtcattggtgttttgagaagctggtgacctagccagagaactgtgatcatgggattccagcttttagaggctgcccacagcccctggtttgcagctctcctcctccatcagccaagccaggaacagcaggttgagtgcttctgatatcacatcactctgacttcctcctgaacttccctcttccacttttaaggacctgtattagttccttgtggcagccataacagattatcacacatttggtggtttaatccatttatgcctagtgtttcactattggaacgctaagcttgtgggaattatttctatcctactgctcgaggtcatcaccaaggtctgatttttcacacaaaaaaatctgcaacctccagcataatgggttaaaacagtagaaatgtattctctcatagttctagaggtcagaaatcctaaatcaaggcatcaagagagccacactcctccgagaggctctggggcctcttccttccagcttttggtggccccaggcttccttggcttgtggcagactcactcccatctctgcctccatcttcacatggctgtctcctctgcatgggtatgtctcaaattccctctgctctctcttatatgtatgcatgtgatagcacttaggatttcaaaaattatcaagaattatcccatccagataatccaggataaacagttcctctcaacatccttcatcacttttcccgtataaggtaatactcactcttttcctacataaggtaatatccacaggttctaggaaataataagtgaatatatctttggggtaccatatttttagccaaccacaagagcctgtgacaaataacactgggcccacccaaaaaaattgataatattctccctgtcttaaagtcagctgagaggcagacttaattccatctacaaccttaattctcccctgccagatcaagtaacatatttacaggttctaagcattcagatgagcatatctgatgggtcattattctgcctagcacaccatgtaacaactgttatataacaaattgtgtcccctctaaaaaattcatatgttgaagtcctaaccactagtacctgagaatgtgactatatatggagataggctctttaaagaggtaactaaggtaaaacaaggtcattaggatgggccctaatccagtgtgactggggtccttgtaagaagtgattaggacacaaatgccacacagagggaagatcaagagaagacacagggagaagacggtcatctacaagccaaggagagatacctcagaaggaaccagccctgcctacaccttgatcttggacttccagcctccagaactgggagacaatgcatttctgttgttgaagccccctagtccatggtactcttttacagcagtcacaggaaactcataaagtcatctaaccaaggaagctataagggaagggaacagacagggagtgggaatcttggagcatcttaaaattcagcctaccacaggtgacagtccccaccagactgtccaagtcatttggaagaaattgtctaacttttcttgcttattccattttcctgggctttctattcatttcccactcaaatttttatcttaattctaattggtctgaggtgagtttggaaggagggtgagtaaagggtggaagaggactgtgtctctagctagcagcagcagaaatggtagaggaaaaaatgcatggtgcccttggcctgtcctacatacaattcttatgaaataaatggtagacatgtgaatagacttcatttttcacagcccccagtttcattttctattgtgaatatttttaaagcaacaaaatctggctatccaacgtacatttttctttaaaatgtatatttttataatttacacatagctgggaaaatcagattctgtttctactctaattcattctgtttatgtgcatgttcacaggccagagctaaacatgataacattgctgataattgcagaattgcagcaacagagcaagagaaagagaactggtgggtcttcccagacctgtgtcagcaggacacatcaagagcattctatgaaaccatactaaatgggaaagccccgcccccacatccatgaacagcatacccagcttccctgctgctttgcttgcgtgcaaaaaaccacagatgtagtggtgagggatggggttggggctggttgagaaaggggggtgtgttttagggcttcagagcaaaatgcagagtcctgggaacagagtgctacagatacagatgggaggaaaaaatctgatgcccctccagccattttggtcttcttcctgaggcagagcagacaatttggcacagggggcctgtgttgttatcttcccatttagtaggggctggccaaactctcatgcaactctgaggtcctagggattcagtggtgaataaaacaaagtgcctaccttcctgcacttacattttagtggaaggaggtggctaataaagtaatttcatccagtattaagtgttgtgatagcaatgggagtctcaccgctttaggttgtcaggggaaacctctctgaggtggcatgagcattgtgacctgaagggtgaggaagagccagctgtgagaagatctgggaagagggtaccaggcagagggaacagctaatgggactgagtatgggaggttcggggaacaccaagaagtccaggaggctggcaaatggtgagcaagtggggtgggaatgaagtgaaaggaagtggcctggcttgtaggccacatatggagtctaaatcttcctgagtgagatggggagctattgggaggattttgagcagaggcatggtatgcctgatctattatctttaaaggaaacttctagttgctttgtggcaaagtgaccacaggtgcaagaagggcagaagaaaccaatttgaggctccaggcgaggagtaaatctgggctggcccgaagtgggagcattgaaggtggtgagatgcacacagatgcagggtgtgccatttgtagtatcccttccctcagggctgctggatcctcttttggaggaaagcatccctgggttgccaggttgcgaactaatgttctccaccttcatcctgtatttaccaaaagggctaacctcaatgcatctttaatggacgcaagagcagggcgtatgtgaaaggaagtgcaggcacgtaagcagtgaaaggtaatggggggcagggaagccagagggttaatagcacaaatgtgcctagaaaccatttctgcttttctccattacctctctggtttagaaacctcaaattcacatactcctattggttttccttctctccaaagtccacagcagtgaggattccaaataagaaaaaggcatcacaggcacagcagtggccatgtctatctacgcacgcctcagttgtgtcttaagttggctgttccccgtactaaaattttcattcaacatcattcattagcactgaagcaaagtcaatatggattgtcaggaacccagtaaaggtctccttattttaaattgcaccttcgatatagcattatcaacattctacctttgcctaataaggtgtgtgcttacttcaggctttatacaaacatcttcaagtccatcattaaacacatacactgggaggcacaattctaaatctccagcagtagttctcaatccagcttcatgttgatcactgcctgttccaaaattttttttttttttttttgagacagagtattgctctgtcaccaggctctcggctcactgcaacctccacctcccaggttcaagtgattctcctgccacagcctcctgagtagctggaactacaggcacgcaccactgtgcccagctaatttttgtatttttagtagagataggatttcaccacattggccaggatggtctctatctcttgacctcgtggtccgccgcctcggcctcccaaagtgctgggattacaggcatgagccaccacgccctgccccaaagagctttctaggcccccacccccagagagtccgattcagaaggtctgggttacatttgggcaatcagttatttttaataaatcctacaaggtgattgcagtaaactttcagaactgctgtcctgtagtttctgcaatgccattacctgtttcctgagttccctggacatctcataacctataaaatttgttaatactaagacgtctcaaatgtgtttgggaaggggatattaacatttattagtaagaattagctggagtcctcagaagcacaggaaggagctggagtgcaatcaacgggtgattagaggacagaggacacaggacattggtcatgagggggtggcatgtggacgtcgtcaggaattatctatttccacatttctcaactctcctttaggggcatttgaagcccaccccagacgaagtataaccagccctttacagctcaacacccctcccccacactcccaatcagtttgagcatttctggttgacatttactgcataaaaacttatccttgacagctctctatataatctacatagcacaaacagaggccaacgaacaaattttttaaagtgagctctgtacatattctacatgttataaaatgagaagcaggcaaacaaatttttaaaaacacagcggttaataaaacattaattgaatcaggacacagcaaagtagcactacaaacactttttttaatgacatcagatggtacatttatacaaattacaagctacaatatagtgaatacaaaatccatccagaaaacggttagaaaagcatcacttaacagaagtaaatcggattcaagtagctaaagaactcaagccccccattttgatgattatacacggcttgaaatgcagcacatccaaatcctccccctagtcagggcactattcaatactacagcatattcaatgactctagtgatgtaaagattctaacacttttagcatcgacgtcaagagacatctcgtaacaggttcactatgcaaaactcaaatgagaatgtgtgaacgttctttgcaaactgtaaggtgctgtgcagatgttgttagctattgctattattactgttcagtgagattacactgaacgtggggaaaaggaagactactctgtataactgacaaatatgacttacagaacatcttaaaaggaatgcagatattactttcaaatacacatagcaacaacacaggcaaggaaagtgtggccaggagtgatgtcgaggaattcctattttaaggaatatataaaggattaagctattcatagattatgtgtaatatttatcattagattcccaaagtccctgaaaataatttatttttaaggtgaccctttccccctgaaaagggaaaaagaaatcttgtcaggttactaatgtgctgcttcagccagctcttgtaaaaattatcttaaacataggagtacagtctgaattaatagttatactaatctggtgggtgacacagagtgcttgacagcagagaaacctgccactgacctcagacaagtgacaaattctgtgtcagagttgaaccataagtttacaacttcacttgggcataaattaaacaataaacatgaacttgtctagagataagaaatacacactaggtacatctaaaatcggatttaaatcctttttatgtactttcgggtttcatctttctttgtatataccctacttgtttaactgattttagtggtctccttgggtattctaactgtatacataaaattgacatgaaaatggaaaacaaacgccaaacaagtcaattggttgtttcttttggcaaagctgatgacattttcatgatgaaaatgttccaattattaggccaggcacggtggctgatacctgtaatcccagcactttgggaggcggaggcgggtggatcacctgaggtcaggagttcgagactagcctggctaacatggtgaaaccccgtctctactaaaaatacaaaaattagccgggtgtggtggcacgcacctgtcatctgaggtactcagggggctgaggcaggagaactgcttgaacccgggaggcggaggttgcagcgagccgagattgcgcccttgcactccagcctgggcaagaagggcaaaactccgtctcgaaaaaaaaaaaaagaaaaaagaaaacaaaatgttctaattattacaatgtatttctgttagatttccatgaaacatggggatttttaatggcaggtttaaattttttttcactaacaaccccaaaccaaattctactgttatatgtacaatggtatccatttgaagaactaatgacatcagatacattctacagcagacttttcatttctcaacacaaatgagaaaaaggactacattctccagggccaaacaggaggtgaggaaggtaatgtgttaccgtaaatagggttaaatcagtagtttggactgacacttcaagttatatctcctaactgaggttattcttacaatcagttttcaaacaatagggaacatatttctaccttaaaacatgtataagggctcaactgtagctttcctttctatacatcttgaagtatatacattgtgtaaaaggaaactagtgagacattttgaaaaataaatctatttgccaaataccatatgttatttaacatagttaaaaacagcagcaaactagtgagttaacagttaaaactctaggaaaaaactgctttgaaaacaagcctattttgttataagcctaaatatcaaccctagcatttgattttaaccttcaaacatttggcgctttttccaagaggaaattacaactgcctttgcatatgcccctggtttaaatacttgcagaaaaatacccatgtatcatcacctattcagcaaatgcctgaaaccaaaacaataatccaacattggacagtaacattttacaaacagcataagatcccaaaagcacaagaaataccttggcattatataaaaagaaattaggtggacaattctaaatacaacaatacttcttaattagggaccatctagaaatctaccacatactaccctagactcaaatgtcattatactaaaattgtagtctttaagcaagaattaaaaacagttccataataatcatactgatctttcacttttctcaacagttaaacacaaatgctatttgacttttatgactaatcatccctctattcctttagtccagtttcacaacataaaaaataaatgtgaacaacaaatcggtaatggtttcacatacttaagcaagaatcctagtattaggattatcagtaacagaaaatttgaattttaagagaataaagatagaatgtgcttatttagaaaatggtcaataaggccgggcgtggtagctcacgcctgtaatcccagcactttcggaggccgaggcgggtggatcacctgaggtcacaagttcaagattagcctggacaacatggtgaaaccccgtctctacaaaaaaatacaaaaaaaaattagccaggcgtggtggcaggcatccgtagtcccagctacttgggaggctgaggtggagaatcacttgaacccaggaggcagaggttgcagtgagccgagattgcaccactgcactccagcctgggcaacagagcaaaactctgtctcaaaaaaataaataaataaaataaagaaaaagaaaaagaaaatggccaataatcactcatctgaaaaaaatgcaaatagctgtcaggaaaagctggcagaatttgaacttgtaagctaaacttttagtgtgtatcaaactagcattaaggaatggctttcaaaaatgaatacgggatatcaactaaaatagaggttatttttagatggcaacattatggggaattttgattttttttcctgtttgaatatgtatttttccagttttctacaaagaacatatactatgattttataattaaaaaacaaatacttgtgggagtgtttttagattgcacataattagtaccaaataactagaaagaacacagactaaagatacgaaaataaaatcaaggtttttttccatcagatatgcccaaggagaatactttttggatgaaaaaaaaatgttttccagattgtttccactcctaacatatgcaaaaatgaacatatttaaatgcaaattcctatcatatacactacaattttaaaaaatagtaaaaaaaacaattttaaatggagcttcctcgaaccttttaattgaagcctagcttcaatgttgaatgaggaagcaaagtatctcattaaaaagttggtctgcaaagcacaaagctggcctgcaaggggacttgaaggaagcaggctgagtgtttgagtagtgagatctttgctttgctctttagatccttcagtaagctaaggtccttttacctgaatggatgtaatttagcctagttttcccataaaataatgtaatggataattcttattgactagggattacacttcatgtgaaattcctcagtgacattcagattaattccagtgtccacaatttaagcaactttccataggaaattaaaatcccaaatccaaggacctggtattttcatgctaaagaaagcattccagcgtaaagtggagtttaatttgcttcactgtgtgcatcttaatatatccaaatgagtaaaactcaaaagcaaccgtaagtcagaatactataaaacatgttttgttgaaagaagataaaattccttccagagtattgtctaattaaattaacatatttctttgtaactaacttttccaaattctcatttgcaaatcagattcatacagttaaaactgaatatacaaaccaacatattagaaagatcaaaatttacatactcaaacgtgactccttaagactgactttaacatgttctttcaactttattcaaatcagatggccccctccagcatttatcattttaaaaaatgaatttaatgctataaaaaggtgatgttcactttaatcctgtttgccttcacgccactgtcgtgagccttcattccaggccacatacacaaagagggccagcaccacatggacggcgaccactgcaacaatagcagcgtaaaaatagctgtccctattggacatcccaagggcgcctatcaagagaaaaaaaacagtttccattttattgcaaaatttaccaaagtacaaaaaaaaaaaacaaagcatcctaatttttatgatgtatttatttaactagtcaggcaattaaaaagtaatattttgggtggtaatgaataaagtattcactaaaagatatgagtaccttctatatattaagaacattatgttggccgggtgcagtggctcacgcctgtaatcccagcactttgggaggccaagacgggcagatcacgaggtcaggagatggaaaccatcctggctagcaccgtgaaaccccgtctctactaaaaatacaaaaaaaattagccaggcgtagtggcaggcgcctgtagtcccagctactcgggaggctgaggcagcagaatggcgtgaacctgggaggcagagcttgacgcgagccgagatcgcaccactgcactccagcctgggtgactgagcgagactccgtctcaaaaacaaacaaacaaacaaacaaacattgttttaaacaaaaccataattataaagacttcaggccgggtgcggtggctcacgcttgtaatcccagcactctgggaggccgaggcgggtggatcacctgaggtcacgagttcgagaccagcctggccaacatggcgaaaccccgtctctactaaaaataccaaaaatcagtcgggtgtagtggcgggtgcctgtaatcccagatactcaggaggctgagacaggagaatcgcttgaacatgggaggcgggggttgcggtgagccgagatcgcgccattgcactccagcctgtgcaacaagagtgaaactgtctcaaaaaaaaaaaaaaaatttcaacatcaaaaaggggacttcattctctcttccttccgttatctgacactaaagtccattcccccaaaattcctcctcccatgtcagccaacccctattctttaaaaggtactaagagaaaggatttgcaagctatttcacagaaaaccataggaaaactgtcaagctgaaacaataagttatttcataaagactcattatgagcaatatgattttttgaaaagctaaacaagaaaaaaataagaatacccagtttaaagatataaagaggtcataaaagcacagaatcttaaattgggggaaaacatcttgttttaatgggtctaagattaccttcaaatatgtaagatttagttgtgaaatataacccaataggaacagtgatcattaaagctgtgaagaacaggagcgtcttcagtgtagatgctaatgagctttcatttctggaataaagtaaacaaagagaaaatcagaacctgcacagtcatatccaaacgctcttatgtccctgaaactataaacatccacaaatgagatgctatgcaggaggaagatcacaggcagggactcgtaatccgaagatcctagagaaccagctgtgggtagtgggaatttcttgagctggaacatgaagattatacaccacctttagggactgtcattcatatccagtgtaagacgaagcgtcagggcacctcagatcaactgccaacaagctgggtgaacaaactaagtgaagaaactcagtgcccctgcctctggaactggagcttttacccagggaagccacggcggacagcggcaccagtgcccaacccatgcggcaaccgtgtccaccagcaccagacaccagagctgggaacgcagcaggcaccatgggtggatcagcgcgccctcttttgctggaatcagagcttccgtcacgggaagcgaccagcttgctgtcctccagcatgagacagtggaccagggaactaacgaggcagacacacctgtgcaccctcccacactggaatcagagcttttgcccagggaagccactgtcacactggtccctgagcccacgcagcaaccctgaccaccagcaccggacaccagaccagggaactcggcaggcaccacaggtggagcagtgtgccctctcccgctggaatcggagcttgcatctgggaaagctgccagcctcctgtcctccagcaccagacagtggaccagcaaactaaccaggtggagccgacgcaccagcgtgccctcccccactgggatcagagctttggcccagggaagccactgccacaccagtccctgagcccgtgcagcaaccctgaccaccagcaccagacaccagaccactgaaggaggtaggcagggcgaacggaccagtgcgccctccccagctggaataggaacttctgttatgggtgaaaaatcgagctagagggaatacttccaaacacgttttaagaggctccaatcaccttgatacctaagccagacagacacagcaagaaaactacaggacaacatcactgatgaacactggtgcaaaattcctcaataacatattttcaaaccaaattcaacaataatcaggccaggtgtggtggctcacacctgtaatcccagcactttgggaggccgaggcaggcggatcacttgaggccaggagttcgagatcagcctggccaacatggcaaaacccagtctctactaaaaatacaaaaattagctgagagtggtggcgtgtgcctatagtcccagctacttgggaggccaaggcacaagaatcccttgatcctgggaggcagaggttgcaatgagccaaaatcacactccagtctgggcaacagagcaagactctgtcacaaacaaacaaaaccaatacatcaaaaagattatatattatgaccaagtaggatcatctcagttgatgcagaaaaagcacttgacaaacttccgcatcctttactgagctgaaaaagaaatcaagaaaacaatctcatttataatagcattaaaaaaaaatacttaggggccaggctcagtggctcatgcctgtaatcccagcactttgggaaggctgaggcttgaggccgggagtttgacgcaagcctaggtaacacagcaaaaccccacctctacaaaaaaaaattttgataattcgctgggcatggtggcacgtgcctgtaatctcagctactcaagaggctgaagtgggaggattgtttgagccccagaggtcaaggctgcagtgagcagtgattggggcactttactctggcctgggtgacagagcaagactctatttcaaaaaaaaagaaacttaggaataaatttaaccaaggcgatgagtgacttgtacactgaaaagtataaaacactgatgaaagaaattgaagatgacacaaataaatgtaaagatatcctgtgttcatggattggaagaattaatactgttgaaatgtctacagcacccaaagcaacatacagatataacacaatctctatcaaaattacagtagcattcttcattaaaatagaaaaacaatcctaaaattcatcatacagaaccacaaaaagccccaaatagccaaagcaacattgaaaaagttgtaagcatcacactttctgatttaaaatattacagttatagtaatcaaaacaatatggtattggcataaaaacagaaacatataacaatgaaacagaatagagcccagaaataaatccaaacatatatggccaactaatcttcgacaggggtgttaagaggaacacaatggggaaaggacagtcccttcaataagtggtactgggaaaacaggatttctacatgcaaagaaaaaaactggactcttacaccataaacaaaaatcaacccaaaatggataaaataactaaaacataaagatataaagttttaagacataaaagaacacagagggaaaggtccttaacattggcctcagtaatgattttttggatatcacaccaaaagctcaggctacaaaagaaaaaataaagcggcttgcatcaaactaaaaagcttctgtactgcaaaggaaacaatcaacaaaatgaaaaggcagcttacagactaggaaaacatatttgcgaaccacctatcttgtaaggggttaataccccaaaatttataaagaactcttacaactcagcagaaaaaccacctgattaaaatatggacaacagctggacagacatttctccaaagacataaaaatggccaagagataaatgaaaatgtgctcaacatcactaaatcatcagggaaatgcaaatcaaaaccactatgagatataacctcacacttctaaggacagctattatcaaaaaggcaagtgataacaaatgtttgtaaaagtgtggagaaaaagaaaccctactacattgtgactggaaatgtagactggtacagccattatggaaaacagttcctaaagaaattaaaaatagaactaccacacagcccagcaatctctcttctggaatataagcaaaggagatgaaatcactacctcgtaaaaatatctgcacttccatgttcattgcagcattattcacaatagccaagatttgaaaacaacctacgtgtatgtagacagacaaaataaagaaaccgtagtgtatatatacaagggaatattttattcagccttaaaagaggacatctgccatttgccacaacatggatggacctggaagacatgttaagtaaaataagccaaacgcagaaagacgaatactacatgagctcacttatatgtggaatctttaaaaaaaaaaaaaaaaggtcaacggtcaactacacagggacagagaataaaacagtagttaccatggcggtgggggtgggaggctggaggggaggaaataggaagatatacatcaaaggacacaaagcagtagatatatggattaacaagtgagatatctaatgtacaagaggactataggcaataaagttgcatggtattagggacttttgtaaataagattttagctgcctctggtcacacacacacaaaagtatgtgagatgacagatatattaatctgcttcaccatagtaatcattttactatatgtatgccataacatcatgttatgaacctcaaatatacacaatgaaatttatttaaaaagaacctgaacaaaaaacccacaaaaacattgagtaaaatatatattaaatataactaacctcatgcctatttcttgatcacatgctctgcacatgtgtgagaaattaaatgcttactgctgtaaaaaaaaaagttctaatattttcttttggtacttaaatggatcatcttttagcaggcctcattttggttattactgagctatacaactctcatttaatatacataagctcccttaaactgtttcctactagtaaatttttagagaaatttattgtgtaatcctcatgaagagtatgagtgtctgcagtggagaatctacaaaaaatacaaagagtcactaattggccaattcttttgtgcaccctaaaaaaagcacttgactttggtgtttctatggtgagtaaaaaagtatgttttaggaatgcaactttcagattatctaacttgttaaaggaacagaaaggaagtgttaactgattgttttgttctttacatgacctctcttgagtatctattatctggtctggcttttaaaaagtttattattgaaaagatgatataacaccataaaaatgttttaaagtaaacaaaatcacctataatcccaccacccaaatataacctttctacatattaatttctagcccccacacaatctatacacagcataccttaataatttatggctaattccttctcacttctctctttacctcaaacttcaaaaatgtgactacttttctgtgttgtgacctcactaatatgggactaagcattaagtcaaagtgtacatacaaacttttgaaaactagcaaacttcctctactgtttataggacattttctccctggattccagccacaagagctgttggttttgctgatgcaagccaccttgggtaaaatcagtggcttatccaagacaaagcaactgatgctattcaattgatttatcctatgtatctttgggtgttactgagcagagatttgttagaagtgaggaatgagaaaggctggaattaaagttgtcctcacacaaaggaaaaagttcaggatgaaccttaatctgcctccatttataacaccacctagttttcccacttcatacaaacttctgcagccaacattgagcagacagagcctaccacattcccttttgtagcaagtaagacaacaggaattctttctcccacagtcaagatttcactgcaaattccattaggaaaccagaatcagtctagaaggactatgctgtaagtgtatctaataaaaatatgttggtattctcataaatgaataattaaaaaaaaacccacattgaggctggataaagaaaatgcggtacatatacaccatggaacactatgcagccataaaaaagaatgagatcatgtcctttgcagcaacatgactggagctggaagccattattctaagcaaattaagacaggaaaagaaaaccaaatactgcacgttctcataagtgggaactaaacaacaagaacagatggacactaggagaggaacaacagacagtgcggtctacttgagggtggaggctgggaggagggagagaatcagaaaaaacgcctatcgggtactatgcttattacctgggtgacaaaattacctgtacgccaagcccccgtgacatgcagtttacctatataacaaacctgcgcatgtactcatgaacctaaaataaaagttaaaaaaaaaaaaaaaaaactcacaatgaccctgtcggaaagagaaggcatcacagagctccaaagatcgtgggctttggagtcagtgagcttggtcaaacgttagcttcaattacatactaactttgtcgcctaattctgtaatcactcaccctcagtttcaagtcacttaccctcaactgcatcctcttcaaaattgggaaatcaagcagttagagaaattaagaattctgacaatgtatgtaaagcacgtgcactgagcctggcatacagtaggtcttaacgaatgatagctaactccctcaccactcccttgcctactggggtgggccagaaccacctgctctctcatacattccttcaactcagtcaccagcctctatcttactgattccccaagtgaagcaatctcacaccaggggactattcccttctactccttcattcatacagcaaacatttattaagccccgactatgcaggccccctagggaacacggagatgaaggagactgcattcctgtcctcagaaggctgaccctgcggtaatgaaagagactgcaatatagacacagcgagagaaagtgctaggataggagcatgagctgaaggcccactgacctattccccatgaccccggatcccttgttcccgagcgaaagttcggggccgggagtttagacgtctcaggctccaacctgctttccccgcccccttccctgaggccaggtccccggggtccagacctcacgcccacccattcagctagggccttccctcaagccctgctccaggctggggccagtccgcctcgcggtccaggccccgctcagggctacctgaactcaggaggctgcagtgcgttcagcgccgccttatccgggcgctccatggtgtagccgtgccggcacaggcgctcggcggcggagctgggctcggcggccgcgctcagtaagctccgcgagggaacggccgaggcggttcgcaccggaagtagcggttcgcgccggaagtgcccgttcgcgccggaagtgcccgttcgcgccgggcggcgggccacagtacgcaggcgcggcgcggcgcggcgcgccgcagcgacgcagggctgttgccggcgcgggggcgggcgctcacatgacttaccggcggtggctccgcggcgtgcgccctgccaggaggggcctgtgctcgaggagcaggcctggcgagtagcccagccactccacgttgagccgggacttgccgcgcaacatggtcctcctgggcgggcggcggctacgccgccccctgaactcgcgtgaacactggtcctcgtctgcgtctcggtcgctgagctgggggccgcaaggagacccgagcatatgagccgcgaagagggactaccagccagagggctgtggtgctaggcaactgagcgtattccgccgacgacaacacaaaaaagcagtgcgcattatttcgccactacttgagcaaataaatgcctcattaattactgcccgcagtggtaggaagtcaagcccttggcagctgggaggagttaaaacactcacccgagtccgtaaaactagagaatgtcagagttcaaagagctcttgctgagaatgactgttccagactcgatgccagtgacccccaacttccacttaaaagttaaaaacatattttgcagctgctcagaaagccgccaatgagacaacagggactcaaatagtaagaacagatgggcctcccgggcctgcgcaacccgagagaggtaaaaacgaaagggtgggtaagtctggagtcaggcttgacaaaattaagttgccactggctgctaataagaggacagcccttaacatggtcagcgcctggaaagggccgctgaccacacagctattttctgcaccacatggatacaaagaccacatctgaaatcatgactaaaccagcagcttagagtggtggaaagggcaatggactgggcagcaggaagtccaggttttagttcaaactgaataatccccctctagggctgactgtgctggctcacgcctgtaatctcaacactttgggaagctgaggcaggaggattgcgtgaggccagtagttccagagcagcttgggcagcatagcaagactccgtctctaaaaaacaaactgtaaaatatttaataaaaataatagtaatctctatctgggcctcatctagacctttaggtgagtaagaaccacctaatgtaagaacttggggtacaaagagaatctacctctggggtaggcaaactgagccagccgacctaatacatggagcctaccacctgtttttctacagccctgaggtaagaatggtttttcctttttaaattgttgaaaacgtcaaaagaataacatgacacgtgaaatttatatgaaattcaaatttcagcgtctattgataaaattttattggagctcagccattctcatttgtttgtattatctacaacagcaatgttgagtagttgtgacagagacggtatgatctgcaacgcccaaaatgatctgcaatgcccaaaattcttaccatctgacccttttacagaagagtttgctgacccctgctctagctaatcagcctgcagtgaggtccttcaatccctagggacccataaatgtagtaatggtggttctgaaggcagtttttaatatttttaaaaacctaatgaatctatttactgttaggcatccaaagctacttaaaatatcaccgttctttgatttttgacacttactatatcatgatgaggttatcctagttatcccataagaaaagactgttcacagattattatgaaaataagccacagtatacttaatagaataaatcttttaaaacatagaatgaacacaagtgggggaacggaattgtgacttattgttccccaatacctagagtagggcctggtatatagtaggaactaataaatatttgttaaataaataaattgggtccacaaaaggaaaaagagcaaaatagttcttgatggtgaaaaaattgggaaccagcttggcgtggtggcacatgcctgtaatcccagctactcaggaggctgaggcagaaaatcgcttgaactcaggaggcggaggttgcagtgagccaagatcgtgccactgcactgcactccagcctgggtgacagagtaagactctgtccacccccccccaaaaaaactgggaaccactgttgttgtagtttgccggagctgccataacaaatgccacaaactaagtggctccaacaacagaagttaatcatctcccagttcaggaggttagaagtctgagatggagatgttggcgaggctggttccttctgaaggttgtgaaggaaggactgttccaggcccctcttctgttttctggtggtttgctgacaatctttggcatttcttggcttgtagaagcatcaccctgatctctgcatttttcttcaaacggccttctccctgcgtctgtgtttctgtccaaattttccctttttataaggacaccagtcataatgcattaggggcccaccctacacctgtatgaacttaattatttacatctgcagcgacgctgtttcactctggggtactgggggctaggatttcagcatatgaatttggggatggtgtgggtgaccgggccagcaattcaacccataacagtagtctaaacacttccttgtacagatgagaaaactgcggcccagagaggggacgggacttgtgggaagtcacacatttatctagtgggatgtagcttgactcctgactcccaggctggcacttttacactcccacattaacagcctaagttgcacttgtgtgataacttaaacaggaaccattcataaatgagatttgctgtgggaaaaacttctcatgtaatttacatagtagtgtttttaaatataaacaaaagctctcatatctcttatttatttatttatttatttatttatttatttatttatttatttcgagacagagtctcgctctttcgcccaggctggaatgcagtggcgcgatctccgctcactgcaagctctgcctcccgggttcacgccattctcctgcctcagcctcccgagtagctgggactacaggcgcctgccaccacgcccggctaattttttgtattttttttaatagagacgggggtttcaccgtgttagccaggatggtctcgatctcctgacctcgtgatccgcccgcctcggcctcccaaagtgctgggattacaggcgtgagccaccacgccctgccatatctcttttttatgctgacttatacactctaccaacatttactgtgagcttactgaggtagacacagaactttaaaaataaactcagaatctgtactagaaggaaagaatctagccagcagtcagccctctcaacagagccctgaaacctcctacctgcagtgctacaaaagaattagaggcaagtggagcccacacagagccgttgccatgggaatgaaatggtgtgttagggggtgtggccactacagaggaaaccataatagtggtttcctaccactgctgccctaaagcatgtgtcttgtgcttcattttactgagcatattcacagtccctacaatttataccatccccacttcataagtggaaaaactgaggccagggaaaatttcagagtctggtgaaggcttcccaatgccccttaaagtcagaaactgattctcaaactgaaagagccccagtttggcactttaattttagttgagaaaactgacagctaaagatgggaagtgatttgccccaaattccctaggtcagtgatagaattagagaatgtatagttcctaattctgtctcatgttttctccaccatattgttgtaaacttctgtactacttgtaagacacgttttctccaccatattgttataaacttctgtactattaacccagtgacgtgaaaagtatacacccaaagacacgttttgcaaccccaaattgctttacttacccgaaaaaacttcgtttcttgaagtttccttttgggtggctggctgtgggattggatggaacaaccatattgaaacaccaactgatacttgccaaggcctatacctgaacagcacggtgtttttaaaactaagacataaggaaaatagaaataagctccactgtacaatcaacaaaactcatattaaaaaagagagagagaaactctggcttctttgtaatgtaggctgtgatgtcttaaaaaaaaaaattggtaaaatatgccccctggtgaaaaagcatagttccatttatagaaaaaaaaataactaaggggttattatagttaaaacctccattgtcaacgctgcccttcgccccaggcaatgaattgggttttactcaagggtcttccttacctcacatcaacctctggccagcactgctgccctaaagcatgtgtcttgtgcttcattttaaatagcatattcacaatccctacaatttataccatccccatttcatttccaggtagaaatagtgaaactaagggaaatttcagtctggtgaggacctcacaatgccccttgcctcctgactcttgaatgccctaaaatttacatcaggctacctcttccagctctatctgccagatagctaagctgggatctctgagctggtgaagggacttgcccatggagtcaaggaatgctcagggttcatgcctcaggactgttctcaccaacttgactcacctttggggctctagtggagcccgtgggccttccggcaaacagaagtaggcaatgggggtcaggaaatggcccccactgcctgtccagcgtggtgccagctcagcctaggatcccatgtcccctggcacaccagtggtttgatataaccagaggatctcctgcccatgaggggcggcagcgctccagttaccaacccccaagtgaaagatcctggatcaagtctttcctgattggcctgcacccagaggctacgctaccagaagaggaactggacaagggcacaccccaagatatacacgcgttttttccttgaaaggcccaggctttgaggaggcgatcgcaaccagtgggctgaataaaagagcaagtgtcggcacggagagagctaggcccgggctcaccaagacatagagcccgagggttctgaaaacactgttcacggtggagcacgaggctcgagcgccagagacctcggagttgggtttccacgtggttattcccagcgccaagtgggcggggcaggggagggcggggcaaggcctcctcccagcttgggccactctgattggtccgcagcagcatgtctttcctggcgagtctgggcaggccaagcagccccgcccacccgcagcccaacgcaaaggggcgggacctagagctggctgcagactgagcgccttgcacccagcaggtgtcggggtgaaatcagagtgtctagcccctcatcccgtggaggctggcaccctcggcctgagctgcactcattgagtaaacaaatacataattggtgaatgcgtgagtgggtgagagaaatcgaagggaaaacccaaaattcttccaggatttcaatgagaaatagctatagattttgttttggttgttttcgctgttctcggttcttactttttccataattgggtggaaaaagttagaaacactcgagagaggaagaaactgcaagaggcaaatgaaacccaggagaagcaaggcaaggaggagctggtgattcgagaatgtgtaataaaaagacgtaaaagatgaataaagtgctccaggcccgggcatgcctggcccttggcttcttggctgagtggtcccaggctgcacctctagctcctgtcctgggaagaagaaatcgccttacaagaggggcggagtgaagggagtgtatgtgctagcgtgtggggctgtgtgtatgagtgtgtgtgcatttgagtatgtgagtgtgcttcactgtgtgtgtgagggtatgtgtgactgtgtgtgtgtacgcgcgcacgcatgtgagtttgtctacatcattgggggaaatataattaaaaacaaaatcttctcccagcccagataacctctccataaaggtagaagagaaagaaaacaattttcttgaataaacattaaatcagaatgtgatatgaatcacaggcagccagctaaaagtattgcaaggacagaaagaaacctcacactaggcatacctcagaggtattgcagtttggttgcagaccagcacaataaagcgaatattgcaataaagcaagtcacgtaatttttttggtttctcagttcatatgaaagttacgtttatactatagtatagtctgttaggtgtacagtaacattatgtctaaaagtaacgtacataccttaatttaaaaatactttattgctagaaaatgctaatgatcatctgaggcttcatctagtggtaatttttttgctggtgtagggtcttgcctccatgtggatggctgctgactgatcagggtggtacttgctgaaggttggagtggctgtggtaatttcttaaaataagatgactatgaagtttgctgcatcgactgactcttcatttcatgaaagatttttctgtagtttgcaatgctgtttgatagcattttatccacggaacttctttcaaaactggagtcagtcctctcaaacactgttgccactttatcagctgtttataaaatattctaagtactttgctgtcattttaacaatattcacaacatcttcaccaggagtagattccatttcaagaaaccccttcctttgttcatccataagaagcaacgcctcatctgtttaagtttgatcatgagattgcagcaattcagtcacatcttcaggctccacttttaattccagttctcttgctatatcctccacacctgcagtgacttcccccactgaagtcttgaacccttcagagtcatccacgagggttggaatcaacttcttttactctcctattattgttgatgttttgacttcttatgaatcatgtatgttctcaacaacatctagaatgatgagtccttttcagaaggttttcaatttactttacccagatccatcataggaatcagtatctatggcagctgtagcctcacaaaatgtatttcttagataatgtactagaaagtcagaattactccttgattcataggcagcagaatggacgtgttgacaggcatgaaaacaacattaatatccttgtacatttccatcagagctctcgggtgactagatgcattgttaatgagcagtaatattttgaaaggaatctctctggtttctgagcagaaagtctcaacagtgggcttaaaatagtcagtaaaccatactgtaaacagatgtgctgtcatccaagttctgtccttccatttatagagcacaggcagagtagatttagcatagtttttaaaggccccaggatttttggaatggtaaataagcattggcttcaacttaaagtcactagctgcattacctctaataagagagtcggcctatcctttgaagctttgaagtcaggtaacagtggaggttaggcccatcttcttccaggaaactgggagatcagacattatctttcttgataatcacattacaaaaagatggctcccaggtccccgaggaaacattcttaacttatgatagtggcaagagggttatgtaatcaccgagaagatttatatacatttgaaaacaacagaaaaagaaatgctttaataaaatggagcaggaggagtcacttatttttcaacaggaagaattaagtatcttaatttgtatttgcctttacaacatagatgtgctaaaagccaagaagtgtgtgggtgtgtgtgtatgtgtgtgtgtgtcctacccaaaatgtggccccaccatacccacctctccagggtgctctcccacacacagttcctcccgtccctgcaccctccatactgtcccttcaccacacacacagcttggatgactttctaggaaaaccaaaacatgctgatcctcagtgggcttgtgctgtgtctgcctctgaagtgctgctgctgcccccatttctgccacctcccaagtgccatctcttttttcagcatctcctatggcatttgggcctacaagttagaacttgatctcttctaactcctattacaactagttgggacttctagtctctcccactagactgtacactagttggggagaggaggacatggctggtggcttttttatctctgtgctacccacagcacaggttttgaacacgtatcctcaatcaaagttgtgacattgagttgcagtgagaatcttactagggccacctttctggctcccatccctcacctccaaccctcacccaccctgtttctgctcctctgcccactaaactctgctgttataagaactcttataacctagtggttaaggaagggttgaggaatatattgaagccagaagaaggagaatttacaaaatgtgttcccagtgtaattccccatcagattccttagggtacatatctgatctagtgcacttaaaatgcacattaccttgggagtgtcacctccactttggtgcctcatgttccatttagacatatgacactggcactgggctttccataggtctcagggctgggcccagacagccagaattccctacctcacctctcaaaaaggccccgagagctgcaagacaaattagagcaggtgttgcctctaggaatgcatggggccatagaagcacacactaccacacacacacaaaaatcctttctagaattgcagactgccaactggtaatccagcctctatatcccccctgccctccaggaacaaggagctcagtgtctttcaagatagtgtactagcatgtcttgcctccatgagtagtccattggtggcagaggtcagcataagtgtcctctgtccccattcaggatgctcacctctgttaaccttgcccgagacttgtcggtgaccacatcacactgccttgacctgactgtcaacaagccccccaaatatctatgcaagcactgccaagtcttctctgacctgcccccagtggattttttagacccaaatgtgtgtccccacattgatccttggtgcatctcacctataagtccacaaggaagacacacaggacccagtgggaaagcagccaggttgcagtgcaacgaactagacttggagttgaaggcctgcacttgaatctgggttcccccaccattttctagctgtgggatcatggacaagacactatctctttctgaacatttgtttatcttatctggaaatggtttattatgaggatctgatgacctaatgggtgcagtagtcacctgatcaactgcaaagacctgatgaaagcagcagcttggccataggagaaaataactggactggaggtaaaaagatctgagagcaagtgtgtctctgggctccggtgtgacctcatcaagtgtcagaactagatgagggtgggactagagggactctaactattagacttttcgagctgtggtttaatggcatttgtcccctttgtgggcagtgggtggagcagaggggttcttgccctagggtggaggaggggatggattactctagatgactagtcccttcctccacaaagtggatgattttgtgttctctgagcctgtggtgagatcacgcatattttttatagcacctagtacagacttgtgtacacagttgggcttagctgaatgaatgaatgaatctttctttcttcatataacagggaaggcctgtaatgggctgttatccttggcccctgacactagggtaatgatggcatcccacggtaaaacatttttgtgtgtaaatatcacttaagtctgcacagcagttgtcaaacagtgaggccctgacagaagccagtgcaccaacctggaaacatttttatggtaatcattttcctacagaactcagagcttcaaaaggagggcattcagatactcccctagaaggttgcagctggaaggaactttcaagatcacagaatcccgccccttcacttcccagatggtgaagcaccagctgcagggggtgaggagaggggtgccttccctggcccgaagcctggctcatagtaggaacataccagaggcttgctgctgcatgcctgcctgcttgacagtgtgccaagttaggccataacagtggggtgagaaaccagccactaaccaggcaaggcagcagggcccaaattagacctaggagtggctggaggtaagaaatcaatataaacaggagctggaaatgagaccatgtggagagagggagggagggagggaagaaggaaggaaagaaggaaggaaggaaagaaggaaggaaggaaagaaggaaggaaggagaaagagagagggagggagggaggaaggagtaaacgaaaagagggtagaggacccagttgggttccagtgacgtaacataaccaagaggaacagtgagatgcccagtagcctatacctggatcaggtgtgatatggaagcttaaggaaaaacatcttctctgtagggagggtgctgggaaatactgaacaggtggcacagatctgcaacttggggcacaccttgggaacaccttctttggccaacaagcattgcccacaatcctagtctatatcctccatggggaccatctctcctggggatgcactgccccaaattcacaattccaacagccttcaggtgcctcgattttcccatcatttggaatgcacatcccatcgatatttttcaaactcctgttcatacttaacagttcagctaaaatgccacttcttgcatggagtaatttttaatgtccaagtcctaactcatcgtccccatggaccccagttgtccgccttcttcaacaatcatctcagtgtgctttatatcagagttcttgggaagtgtgtccctcccagcccaaacctcccttcagatcactcctttattgcactcagagaactggtttcatgtatattcctggttcctttagtgcctgcattacaggtgctcagagggcatttgtggcccaaaggaaagaatggctggacaggggctggctgcccggctatagcacttcataaagcagcactccctctccaacatcacccaggaaaggagggaagggaggtagagaaggagaggaaacggagggagaagtgaagggagcaaagaaggaaaggaaggagaggaaggaagggagggaggaaggaaggacaggtgagaaaacaagagtatcctagggagaggtagttggggagggtggctgtggtggtggactagcagaccagattccccacacaaggcaggcacttcatagtttcatgcatggatttactcttacattcatttgctgagtgcctactatgtgcaaggcactgttttgttttgttttgttttgtggtggtatatcctagtggttaaggaagggtaagactgtgttcaaatcccaattctgtcattcactagctatgtgatcttagacaaattacttcattctctgtgcctcagtttctttatctataaagtgggtatcctaatagtgccttccttataggctcttgtgaagattaaataatttaattgatacgaagtgtgtaaaacagtgtttggcacatagtgtgctttatataagccctggcgattattttacgcactgtgaatatatattctgctcacatcagtgaacaaagccaaccaaaattttgcccctattgaacttaaattctagtggagggagaccgacaattaacagcaacaaaggaaatcatgttaggaggtgagaaatgatgtccggaagcagagcaggtaaagggaagttcggaataggaaggtgggagtctcaattatagataagatggtcggaatgtttctcacagagagaagacctgtgtgttgactgcctcagctgggacctgcagcatgggactggccagctcaccatctctccaactttgctagggcacccaaggttgcatgcgctcatgagcgtcctttggggacaggaggacatccttcgaaagagagctcttagaggccaggtgccttgtgagtgaaaagctgtttgctgttgagttagaaaaggcacagaagctgctgaggaactgggtcctttgccagcacagcagggtaaacacttgtggccaagtctggcagcagctgagcctctgcggagcaaacacgacccttgcagctggcacagaggcagctaggggagccaaaaccctttggcgatcttagctaatgagggcctgcagtatgaagcttggctcccacctttccgttagatgggagcacatcacttttttcctaagctgggcttcttcttacctgggaaggctggtggaacagactgggagtgccctggatttttaatgatgcataaagtacagagggttttgctgtggggcattcagagagagacttttctgagtttcttgggcaatgactctagaaagagctataggatagtcatattctgcagggatgtgagagctgtaagaaagatcaaggcaaccccacagctccagttatacagaagtatactcaaaagtcactttgccaatcccaacccctccttttgcttcctgcctcaacacctatctcctgccccgcattctgttccaatgctgtttgtagtgactaaggtgctatttcatttttggattgtgtccctgcaatttgatcataaggtcctcaagatcatgaaagtttttgagaaggtgacaaattctacaaggaccactcaggaagatatattcaatcatttattcaataaatatttattaagcacctactaagcgccacgcattgttctcagcatttgggaaacagcagtaatgaacaaaacagaccaaagttctttcctcatagagttccctattctagtgggacaaacaggctataaatataacacatatataagacagtgtcaggcagcaaagctggccatgaaaaaaatagagcagagtaaggggacttagagtgatgggggaccatttcatttggggtagacagggaaggttggtacagttctgtcacttcactcatgtaggaattaaggtcaaaagagataaagtgtcttttccaggaccacacattgaggagcgagtgagcgaatgagagtctgacaaccacgtatgacctctgttcatattttatgtatttccttccagatatataaacatgcacatgcgtgtgtatcgtgtgtgtatgtgtgcatgtcaatagacactgctttagtcagtcctggttgctagaacagaataccatacactgggtggcttaaacaacaaacatgtatttctcacagctctggaggctgcatgtcttagattagggtgccagcatggtcaggttcttggtgagggctctcctcctagtttacagacagctgtcttatcgtttgctcaagtgatggagaaagaaatcgtctgtcttatgtctcttctttaaaaggcactgatcctattcaccaggcctctgccctcttgaccaaatcacctcctaaaggccccacctcctcataccatcacactgaggattaggatttcaacataggaatttgaggggaacacaaacattcaggccatagcacacacacataccattattttcccctcaattgctgtgttgcaaacttttttttcacttagccatattcaatttccaatgtcaatacacattgatctacattatttttttcaagttagtgtttgtaccaatttttaatttttctttattgagctaaaatttacttacagaaaaattcatcctttttaggtgtacagttctatgaattttgacaaatgtatacagccatttatcactataatcaagggagtgaattttctgattattccaagtagttcctcatgcccctttgtaggcaattgccttctcccacctccatatcagatccttggcaaccaacgatctgattcctgtcccagtaattttaatttttccagaatgtcatataaatggaagcatgtagtgtgtagacttttgtgtctaccttatttatttagaataatgccttttgggactagtttacattgttgcatatcagtaatttattctttttattgctgaatagctctccattttatggatatattgcaatgtgtttatttattcaccagttgagggacactggattgttgccagattttagtgatcatgaaaaaatcattataatcatcacagacagggttttgttgttgctgttgttgttgtttgttgtttgtttgtttgttttatttgtttgttttatggccatgcctttatttttcttgggtaaatatctagcagggggattgctaggttgtattggaaatgtgtgttgaactttataacaaactgccaaactgatgtccaatgtggctgcaccattttgcattgccacaagcaaagtatgagaattctagttgttccactttgtgatacatattgttttaattttagccattcttgtaagggtgtagtagtatctcactgtagtttaaatttgcttttccctaatgaccaatgatgtggagcaccttttcatgtgcttttttgcctttttctttttcttttttcttttttttttgagacagagtctcactctgtcatctagcatggggtgcaatggtacagtcttggctcactgcagcctccaccttccaggcccaagcgattctcccacctcagcctgctgagtagctgggactacaggcgtgcatcaccatgcctggctaatttttgtattttttgtagagactagtttttcaccatgttagccaggctggtctcaaactcctgggttcaagcgatcctcccactttggcctcccaaagtgctgggactacaggcgtgagccactgccctgggcttgccattcatatctctcttatctcctctttggtgaagtgtcaattcaagttttttgctgctcattttctagttagactatttgctcactgctgagctatatggcttgctagagctgttgtaacaaattaccacaaatttagcagcttaaaataacgcaaatatatcctccttacagttctggaagccaaaagtgagaactgagtcttctggagtgtcaagatgtcagcagagctggttccttttggaagtcctagcgtagaattcattccttatctcttccagcttgctggcattccatggcttgctggtattgcatggcttgtgtcctcatcacccccaaactcggcctctgtggtcacattgtgttcttttctgtagtcaaatcttcttctgcctccctcttgtcaggacacttgtgattacatttagggcctacctggataatccaggacaatctccctgtctcaagactcttaatttctttttttttttctttctttctttctttttttttttttgagacagactctcactctgtcgcccaggctggagtgcagtggcgtgatctcggttcactgcaacctctgcctcccgggttcatgccattctcctgcccagcctcctgagtagctgggactccaggtgccggccaccatgcctggctaactttttgtatttttagtagagacagggtttcaccgtgttagccaggatggtctcaatctcctgaccatccacctcggcctcccaaagtgctgggattacaggcatgagccaccgcgcccagccaagactcttaattgaatcacatttgcaatgtctgattttggcacatgaggtaacattcacaggtttcaggggttaggacctggataactttggggactttattcagcctaccacataagtttagagagttctttatggattttggttaccagttctttatcagatatatgctttgcaaatgttgtctccttttctgtggcttgtcttttttattttcttaacagtgtatcttgaagagcacaaatttgaaaattaaaattcttattttgatgaagtccaagttgtacattttatcaattttttttctattatggtttgtacttagtgtgccctatctaaacaagatcataaagattttctcctatatttactttcagaaatgttatggttttaggttttacatttaagcctaggaacaattttgaggtaatttttgtaaatggtgtaagatatgggttcaagttcattactttgcaccatctgttaaaaatactatactttctctgttcaattgcttttgcatcttgtcaaaaaccagtagactatgtttgtttatttctggactttgttatgtctgattgatttatatgtcagtccattcacaaatactacattgtcttatttactgtagctttatagtaagtcttgaaatttgatagtctcagtcctccaactttgttcctctttttaaaaattgatagtttttaaaaatttcaattttcagtggctgttttgctagtatatagaaatacaattgattttgttgtatattgtaaattggccttgtatactgttctagtagctttcttgcagatttcttgggagtttttacatagacagtcatgttgtctgtttatatagacagccttattttttccattccaatctgaaggtactacatattttccttgccttattgcattgaccaggaccctcaggatgatgttgactaggagtgatgtgagtggacgtccttgatttactccaaatcttacggggaagcatttagtctttcattacaaattacattcttaggagcatattttgttgttgttgatgcccttagtcaagaagataaggttctcttttattcctagtgtgctgagagtttcattatgaatggatgtgtgaccatgtggtttttccttctttagactgttcatagctcatagggtggattacattgattcgctttttaaatattgaaccaactgcattttcaggataaatatcacctgctcatgatatattattatttttatatattacttgataaatttgctaatattttgttaaagatttttccactatattcatcaggcatattggttttttgctttgggggattttgttcttatattgtctttgtgtagttttgacattggagtaatgctagcatcacaaaataatttaagaagtatcctctcaccttctgttttctggaagtttttgtagagtaggcattacatattccttaaatgtttgatagaagttgcaaatgaagccatgtgggcctggagcttaatttgtgggaagatttctaactcgaattctgttcaattcatttaaaagatgtaagacttccagttatctatttcttcttgaatgaatgttggtagtttgtgtctttcaatgcataagtctatttcacctaagttttgaaatgtgtaggcatagtgttgtttgtagtcccttattatctattaatgtctgtgacatagtatcatttttaatggttgccggatatgacattatataaatgtatcataatctatttaaccattctgttattgttgaacatttaggttatttttgtttttcaccattataaatacctgtgtgatgaacatacatgtaaacacatgttttgtagagatgtctacttccttcagatacatttctagaagtgggctttatgcttgttatctattgttccataatgattacccccaaaacttcgtgattgaaaacaacaaaggtgtcttatctcacagtttgtgtgggtctggattctaggcattgctcgagtggatcctctatctcagggtctctcacaaggctgcaatcaatgtgttggctggagctacagtcatctcaaggccttacttgtggagaatctacttctatacttacttacatgattgttggcaggattcacttcctcccaggccagtgaggtgagggcctcaggtcctcactgcccagttgtggctcagttccttaccacatgagcttctctgtagggcagctcacaacatggcagctggcttccatcagagcaagcaaggaattgagagaccaagacagggtaagcaagatagaagtcgtggtctttctataacctcaccttcgaagtggcatcccatcacttttgccatattccatttattagaaatgaatcactaggtctagcccacattctaggagaggggattgcataaggacacagatctgagcaggtgaggatctttggagggtattttagaagctgtctggcaaggaatgttggttgggagagcatgtagaatcctttcattgtttgtaaagaattgtgattattatttcaactcaaaactctcttttactgttcctcaaatatctagtttttttgatgatcatttttaaataaaatagtaaatagaaaatatttataaagtatgtgtaagataaaaagaataacatcactcacattattaccactcaagtttatttttaaaaaatatatccctttcctctctctcccaggactaatcactattctatttttatgtttgatattcctttgattttctttaagtttaacacacatatgtatttttaaacattatattgcttagtttcatttgattttgaactttatcttgcattgcatgtatcattctgacttgatttatttttggccaaaagtgatactcctgagattaatttatgttgttgcatataactgtctttcatttgttgtatctgctagacaggatcacattgtatgcatctactataatttgttaacactttcaacagtggcagacatttgttataacaaacatgcagttatgaatatttttttttcttgaagcaggttctcactctgttccccaagccagagtgcagtggtgcaatcatggctcactgcaacggtgcaatcacggctcactgcagcctcaaccttccaggttcaagtgaatcttccacttcatcttcctgagtagctgggactacaggtgtacaccaccgtacctggctaaatattttattttttatttttgttgatacaggctctggctatgttgcccaggctggcctcgaactcctgggctcaagcaacccttttgccttggcttcccaaagtgctaggattacagacgtgagccactgtgtccagccccagttatgaatgttcctgtacatatacatagctccaggtgcctaggtgcgtaagtttctcctgaagacagacattgccattctggtgggttaggggctgaatcgtgtcccttcaaaattcacatggtgaagttttaacccccagtacctcagaatgtgattatatttggagatagaacctttaaagaggtaattaaggtaaaataagatcatacgggtcagctctaacccaatgtgtcggtgtccttacaaaaagagatttgcacacagataacacacagaccgggtgctgaccatctgcaactcaaaaagagaggcctcagaagagactaaacctgctgccatcttgatcttggacttctggcctccagaactatgacaaaataaatttccattgtttaaggcacccagtctgtgctattttgttatggaagccctagcaaactagcaaaatgtgggtattttgctgtgatcttaatttgcatttatttaatttgagcatccttttagatgtttatggactacttgggcttccccctccataaagtgcttggtcatgccatttgcccatttgttgttattgttattgtggggttatttgtcttttccttgtttgtttaccacttttctctatatattctagactttaatgtattgcaacctatatattctccattgtgtggcttgtcctttcactctcttaatttttcacttttctcactggtccatgctagaatatctcatgtcttatttacttttttattttaataacataataaatacttgtgaacccactgccaatccaagagctaaagcattagtaataaattcacttaacagctttctcatctattccatccctctgccattcatttcctcaaaataatactagtagctaacatttttctggctctccctaggtgcccagtgctgttttatgcactttctgtttactaactcacttaaacttcaccataaccctgtgagttagctatgttatacacacaagtcacagaagcacagagaggttaagttacttgccaaggtcacacaagcatgtggtgacaaagccagaatttgattgaagccaggcagtctgctccttaaccattttactgtgctgctcattgttaatcactatattaaattttgtgtttctcaacccaaaattttgctgtgtttagttactgttaaaaaaattaattactgtttaaaaattctttaattactgttaaaaaatttaattactgtttaattactgtttaaaaattattacatatttatgtatgcctgaatcatatagtttttagtttttgcttgttttattaactttattaaaaatgccccatgccatatgctgttttgggaaacaacatatggggttattttgattaacagaagttcctaatagcagcatactttacattatcaatcttttcccttatggtttgtgtttttgtgggtttttttttaatcttgtttaagaaatcttttcctaactcaaagttacaaagacatggtcttgtattgccgaacaaaaaacctatagctttgcctttcacttttgtgatttaatgtttttttattttgaagtaattttagactcataaaaattgaaaaaaaacatagtacatcgaattcttacactcttcaccaggcttccctgaatgataatgtctacccaactataatataatgatcaaaactgggaacttgacattggtatgatactattacctttagatcttattcgaatttcaccagtttttacatacatactttttaacttcagtgcatagttctatgcaacttaacctatgtatacatttgtttaaccaccagcacaatcagtatactccattgtactatcctcccctcaaccctaacccctggcaatcgttgatgtgttcattatggttttatcatttcaaggttgttatacaaatgggataatacagtatgtgacctttttaacactgggctttttttcactcagcataatgcccttgagatccatcaatgttgttgcatttatcaatagtttgttcctttctattgctcagtagtattccattatatgggtggaccatattttctttatccattcacccattgtcttagtctgtgtttctgttgcttataacagaatgccagaaaatgggtaatttatttttttttaaaaaaaggaattcatgtattaaagttatggaagttgagaagtccaaggttgatgtgccacatccggtgaggaccttcttgttggtgggaaccctctgttgaatcccaaagcagtgcagggtctcacatggtgaggggactcagtatgctagcttagatctcccttcctctgcttataaagccaccagtcccacttctaggataacccattaacccatgaatggattagttcatttatgagggcagagccctcatgacccagtcacattttaagggccctgtctttcaatactcccacattgggatgaaatttcaacatgaggtttggatgggacaaacgttcaagctatagcacccattgagtagcatcttggttgtttccagcttttgcctatcacaaataaacctactagaaacatttatatacaggtctatgaatgaacataagatgtatctctctgggatacatatacaggagtaggattgctaggtcatatgataattgtatatttaactttataagaaactgccaaacctaagaaactgccaaattgttttccaaagtggtggtagcgttttacgttcccaccaggtatgtatgaatgattcagtttctccaaatcctcagcacttaatattatcacaatattttatgtattttattatttattcattatttctgttttagccattcaagtgagtgtgtactgatgtcttactgtggttttacgttttcctaatgagtaatgctagtcaacatcttttcatgtgcttatttgccatcatgatttcctcttaggtgaagtgtcagtttaagtctttttgtccaattgaattgattgctttcttactgcagtttcgagagctctttatatattctggatagaagtcctttgtcagatatgtgacttgccaatattttctcctagtccgtggcttgtctttttattctttttagcagtgtcttttgcagagcaaatctttttaattttgaggaaggccagtttatcacatttttaatggatacgcttttggtttcatgtctaagaatcctagggcaagaagattttcccctatgttttcttctaaacagtttatggttttatgctttacatttagacctgtgattcactttgagttaatttttgaataagatggggccaggtgaggagggggcaaggcaccagctcactagcgcaggacagggagtgctgacagggctctacctcccagtctcagcaataccaggtgggctagtattgcaggttccttttgtgttgtttacctggagcacagagattaattaaagggttttgtcctgtagggctgcccttttcaccgttctagagaggattggccagagagtataggattttcttaggactttatgtttctaggttgtgagctgttctagtacctacgctatgaggcaaaacaaaaaaacaaaaacaaaaacaaaaacaaaaagaactcacagcttggtcttcccttagtcccgaggtaaccagtacaccctcttttctccatctttcagagtcttcagataattaaatattttgtccagggttttccattgtaattagtgggaggaatgcatttcctctgttttgtctgtacctgaaaactcatatttaatactttaattcacaaggaatttatttttctgtatagtgagggttagggatccaattttacttttctatatatatagtatacatttgatataatgtacacattacatgcatttgatataatgtacacattacatgcattagatataatgtacacattacatgcattatataaaatgtacacattacgtgcattatataaaatgtacacattacgtgcattatataaaatgtacacattacgtgcattatataatgtacacattacatgcattatataatgtacacattacatgcattatataatgtacacattacatgcattatataatgtatacattacatgcattatataatgtatataatatagtatatataatgtatataatatagtatatataatgtatataatatagtatatataatgtatatataatatagtatatataatgtatattatatattatatgtatattatataattacattattatgtaattataatgtatattatacaatatataatataatataataatatataataatatataattatataattataataattatattatattatatattgtatattatatattatattatatattatattatatattatataatatataatatatatatattatataatataaaatataatatataatatataattaataatatatgtaaaatcagttgtttcattgccagtttgcaagtagttcattccctctcccaccccaatgatctaaaaaaacagctctgatacctggtaaggtcaggcccctcaccttattctccctcagaaataccttggcatttcctgtggacatttgttctcccatataaacttatgattctgcttgtcaagtacaatgaaaaaatatgttgggatttttattagaaataaaaatctgcatttttatgcagtattaaatctgcattgaatctgcaaatcagtttggaagagaatgaacatctttacattgttgagatttccaatccattaacatgttatatttcttaatttatttaggctttctttaatactcttgcacatctcttgtttgatttattcttacttgctttaaatttttcatgagcccattaaaagagcccattgaagaattattggcatcaatgcaagagctctgtaaagtgactgggcacagactaaaatacacaaaaatccaaagcttgctgataatataatttggcaataattagtttgaacacaaaatggaaaataaaagctccccttcacatcacaatataaaatacccagtaatgaacctaacctgagagatataattggcagtaagcacttgcagccaacattacagaccaaggaataatatccttaagataaaacagtatcacaagttaataaggacagcacagacctcccaagaggaaagtgaataaaaggttggaatagaataatcacacaagaagtaatagaaatgaataataaatcacaaaaacttcagtctcactagcaaggcaagagaataaaataacaagactttttcacccataagtctggcaaatacttgctttttgcttcacggtgttgccaagggagaggaaacatctacctcttatactgctgatgggggtataaatgtgcatgtttccataggacacttggctgtgtataccagtcaattctatttcaggacacttgttctaaggaagtcatcagactagcacgtctcacttttctcatctgcaaaatggggctaatcgtgcattcatcatagtgtaataatgagcattaatgagacaattcctttagggctgctaatctatatgatgctttagggaaatacaaaaaagtcaccctcactctgctgataaattgcttcttttccaggcaaatgtccaggggcttggcaaatgcacagggcgtttgtgcaaagaaaaaggctgtgcctcttcctccaggctactctgcctgtagagtgaagagtaggcttgatttaagcgcccacttcgcaccctggctagcacctttgctaaggacacatatacgatgaccctgaatccatgtaaagtttttagcaaaatgtctggcatttgatcattaaatattatatattactgtgttcaagggcatttaatacagtgatattcatacgggtgacaatttgaaaactaaatgtacagaaatatgggactagttacattaatttggcatattcatataatggagctcttttaattcatgttttaaaccactattgaatggtgttgggaaatttccaaaatatattaagtttaaaacatcaagatccaaactggatagtgagggtaaccccaattttgtaaaaatcccactatatttacatagatatgtatgtatgtatatatgatatatataagtgtgtataatatatataaaaaaatatatatatataaaacatatgcaacaaaaagttgacagttacagtggttggagagtgaggtaatttttgtttcatatttaccctttctcgtggttttaccaagtgtctggaatgtgtatacttactcttacaagcagtaaaaggtcatttaagaagtctcttctgtccctaacctgtcttccctgtctgtggccctggtcgtggagagggtaaggacatcctggaaggcagattttcttcctttctttcctttctttccttcctttctttcttctttctttctttctttctttctttctttctttctttctttctttctttctttctttctttcttttctttttcttcctttctttcttcctttcttcctttctttttttttcagggtcttgctctgttgcccaggctggagtgcagtggcacaatcacagctcacttcagcctttaagccctgggttcaaggatcctcccacctcagcctcccgaggagctgggactacaggtgtgagccaccacgcctggttctgtcaggtgctcttcgagggcagtgtcccggagagcaactgcggccctggaggcagtgggcgctgatttgtttaacctggctccaagcccgccttaatctccccgagcctaagtgagtcgcctgggagccgatggggccactctgcacattcacacatcaggaagaatgctgtgcttttcagcaggcccaggctaggtctccgactccagggaagccgagtgtggagtaccagcctgcgctgggcgcaagcgaggagaggtggtgaggggcgggactgcatgcaacaggcccggctcggccccgccccctctcctctgagttctttcgatgcggtaagaagggggaaaaactaaacggcaacacaaccgtcttatttatttgggaacaaggtatctgtgtcttgccctaggaactccttgcgaagtgcaccgagaaaaaaagtggacaaaatccatccatgcaacaatcctatcgctagatcttctctataagaactagtccccttgatagaaatagaataccctccctggggcatagggcagacaggtcttgggaggaacaaacgcctggactggggcagctgcctgggtgacatctcccttgcccactttcctcatctgcaaaatggggctaatcacgccttcatcatagtgtggtgaagaggattaatgagacaattccctttcctaatctatatgatgctttagggaaatataaaaaaggcaactcttccttagggtcctcttattttaatcctcgtgatactctctcagaggaaaccaattggaggagttcatattcgactgacccaaggagcaatttccctacaatcaatgggtgggttggaataatggtcagtctcaaatgaggggattgtaatggaaaagttaacttctttgtgatttcatcagtacagagcaagtctagccagcagggaacagaacaaagagatttgtacaggacattctggaatcagagcagcttggttcacatcttctcaacttggtagctgtgtgacattaggccagacacctaacctatctgcttctgcattctattctgtgaaatgggcagataatagagtctacctaccactgacgttgatataagagtgacatgcgcttctgcccatcatacaatgctagggcagggtcagccctggggtagggggcaatcagtggggtctgcttgctctgggacaaagtgctctcttcctccccaccacccacagtgagttcccagcaccttcatcccagtgcttcttattggaagcacgcccatctcagatgtgaactctgggggctcaagaggtagacttgctggaagttctttgtagcttctggatattagccctttgtcagatgggtagattgtaaaaattttctcccattctataggttgcctgttcactctgatggtactttcttttgctgtgcagaagctctttagtttaattagatcccatttgtcaattttggcttttgttgccattgcttttggtgttttagtcgtgaagtccttgcccatgcctatgtcttgaatggtattgcctaagttttcttctagggtttttatggttttaggtgtgacatttaagtctttaattcatcttgaattaattttagtataaggtgtaagtaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtatcagtaccatgctgttttggttactgtagccttgtagtatagtttgaagtcaggtaacatgatgcctccagctttgttcttttggcttaggattgtcttggcaatgtgggctcttttttggttccatatgaactttaaagtatttttttccaattctgtgaagaaagtcattggtagcttgatggggatggcattgaatctataaattaccttgggcagtatggacattttcacgattttgattcttcctatctatgagcatagaatgttcttccatttatttgtgtcctcttttattttgttgagcagtgatttgtagttctccttgaagaggcccttcatatcccttataagttggatacctaagtattttattctctttgaagcaattgtgaatgggagttcactcatgatttagctctctgtttttctgttattggtgtagaggaatgcttgtgagttttgcacattgattttgtatcctgagactttgctgaagttgcctatcagcttaaggagattttgggctgagacgatggggttttctaaatatgcaatcatgtcatctgcaaacagggacaatttgacttcctcttttcctaagtgaatacgttttatttctttctcctgcctgattgccctggccagaacttccaacaccaaatatggaaaggaacaagcggtaccagccactgcaaaaacatgccaaattgtaaagaccatcgatgctaggaagaaattgcatcaactaatgagcaaaataaccagctaacatcataatgacaggatcaaattcacacataacaatattaaccttaaatgtaagtgggctaaatgctccagttaaaagacacagactggcaaattggataaagactcaagacccatcagtgtgctgtattcaggagacccatctcacgtgcagagacacatataggctcaaaataaaggaatggaggaagatctaacaagcacatggaaaacaaacaaacaaaaaaaagcaggggttgcaaccctagtctctgataaaacagactttaaaccaataaagatcaaaagagacaaagaaggccattacataatggcaaagggatcaattcaacaagaagagctaactatcctaagtatatatgcacccaatacaggagcacccagattcataaagcaagtcattagagacctacaaagagacttagactgccacacaataataatgggagactttaacaccccactgtcaacattagagagatcaacagacagaaaattaacaagcatatccaggaattgaactcagctctgcaccaagcagacctaatagacatctacagaactctccaccccagatcaacagaagatacatttcttctcagcaccacgtcgcacttattccaaaatcgaccacatagttggaagtaaagcactcctcagcaaatgtaaaagaacagaaattataacaaacggtctctcagaccacagtgcaatcaaaccagaactcaggattaagaaactcactcaaaactgcacaactacatggaaactgaacaacctgctcctgaatgactacaggttaaataacgaaatgaaggcagaaataaagatgttctttgaaaccaatgagagcaaagacacaacataccagaatctctgggacatatttaaagcagtgtgtagacggaaatttatagcactaaatgcccacaagagaaagcaggaaagatctaaaattgacaccctaacatcacaattaaaagaactagagaagtaagagcaaacacattcaaaagctagcagaaggcaagaaataactaagatcagagctgaactgaaggagatagagaaacaaaaaacccttcaaaaaatcaatgaatccaggagctggttttttgaaaggatcaacaaaattgatagaccgctagcaagactaataaggaagaaaagagagaagaatcaaatagacgcattaaaaaatgataaaggggatatcaccactgatcccacggaaatacaaactaccatcagagaatactataaacacctctatgcaaataaactagaaaatctagaagaaatggatacattccttgacacatacaccctcccaagactaaaccaggaagaagttgaatccctgaatagaccaataacaggagctgaaattgaggcaataattaatagcctaccaaccaaaaaaagtcgaggacaagatggattcacagccgaattctaccagaggtacaaggaggagctggtaccattccttctgaaactattccaatcgatagaaaaagagggaatcctccctaactcattttaagaggccagcatcatcctgataccaaagcctggcagagacacaacaaaaaaagagaattttagaccaatatccctgatgaacattgatgcaaaaatcctcaataaaatactggcaaactgaatccagcagcacatcaaaaagcttatccaccatgatcaagttggcttcatccctgggatgtaaggctggttcaacatacgcaaatcaaaaaatgtaaaccgtcatataaacagaaccaaaacaaaaaccacgtgattatctcaatagatgcagaaaaggccttcgacaaaattcaacagcatttcatgctaaaaactctcaataaactaggtattgatgagatgtatctcaaaataataagagctatttatgacaaacccacagccaatatcatactgaatgggcaaaaactggaagcattccctttgaaaactggcacaagacagggatgctctctctcaccactcctattgtcctttatgttctatagtttaactgccatctccttaaaaagaaattcactatggacagcttcctttgaaggcatttttctttagtgaaatcttggggccaacagttcaagctttctttctcggcctctttctttttccaaaggggcctcttcttttatctgggatttatgtctggcatatttcccatgtaaataaagtggctttgctattataaaataggaaggtatcccactcgcagagaccacctgagtgatgtataacagggcacagaatcgtagggtgtcacttttccaacaatctgcacttcctatagcagatgcacagcccgggctacgtgaggacctctccacaagagaggcaattgcaaatggggggaaatgaactgagtctggctatttattttctgggtggagccatcacaggaagacaggcagtccccaagcctccacttttggctgctaagagttatctacaactatttcaacaagataaatgattgcatgggagtctgacttggcagaaagcaaaataataggatactgcttgtttgttttggaacttggtgtctcaaaccttgggcacattggatggtaacacctatttgatgtagcaatttactatcagcagactcttctgggtgccttacagacatgacccacccatttaatctgagttttcctaattgctgaaattggagtgcctaccctgcccactgggcaaaaagactccatgtaattgcaggagaaccccggacacccacaatggtggggagctctcccttcattgaagatgcacttgtaactcctttgcggggagctttcctcttcttcagctcatatccacagaattaactccgagaattaagtaggacctgagtgataaagataaagtgctcaaggcttcaatgttacacttggtgccaaagttaaaccacaaatctctttatgacaaagtatgtggtaaccaagatgaaacctggccctggaggctgcagtggaaaggatgcaagacaaacttctggcataaagatgatagctgcacaccttgctctaaatccacaaatgtgagagaacaaaaagaaaagtacatatatacacacaaaggtatgctggaagtaagaagagaaactctcagtggacctgaaactgtgaaaaataactgaaatacaaaaatatagaaaacagacaggagcaagagagatgtggggaaattctgccaagaaaagtggtggattgagtacttttcttcctctagcttttatgtttactgtccaagttttgcataattagtatgtgtatgttttatgatgaaaaaataagttttattcctgaaataggcttcgggaaaggaaagggaagggaaggaagggaagggaaaggggaaggggaaggagaaggggaaggaaaggaaaagagcaaatcagaagtcagacttgctgggtactaggccagattgccccagactccctgctaggcttgaccttagccctgcctgtcttggggcctccattttctcatctgtaaaagaaggcaggcaaactggaccatctttagagtaaggtcttactcagagttcagatcacctgggtgtgggaggagggagttatggggaggttttgtcctgtgtctgagcaagagattagaaggtggtttgaaaatacttaagagtaaatttaaccaagggggtgaaaagttttttatactgaaaactataagacattgatgaaagaaattgaggaaaacacaaataagtggaaagatagcccatgttcatgagttgaaagaattaatattgttagactgtccatactacccaaagtgatccacagattcaatgcaatctctatcaaaatcctaacagcatttttcacagactagaaaaagcaattctaaaatccctatggaaccacaaaaaaaacctgaataggcaaagcaatcctgggaaagatgaacaaagctggaggcaccacactccctaatttcaaagtatactaaaagctatagaaatcaaaacagcatggtcctggcacaaaaacagacatagactattcatgaattgagagcccagaaataaatccacccatagacagtcaactagtatttgacaagagtgccaagaatacacaatgaggaaaggatagtctcgtcaataaatggtgttgaaaaaactgaatgtccacatgcagagaaaaaaactggaccacgatttacatcactcacaaaactgaattcaaaatggattaaagacctcaatgtaagacctgacactataaaattcccagaataaaacataagagaaaagctctttcacactggtcttgccagtgatttttttttttttttggatatgacatcaaaagcacaaacaacaaaagcaaaaatagacaagtgggagtacattaagctgaaaagcttctgcacagcaaagggaacaacaaaatgtacaggcaacctatggaatgggagaaaatatttgcaaaccatatatctgataatggattaatatccaaaatatatatggaacacatacaactcaatagcaaaaataaatactctcataaataatctgattttaaaatgagttaaaaaaaacttgaatagatatttttccaaagaagacttacacatgccccataggtgcatgaaaaggtgctcaacatcagtaatcataaggaaaatgcaaatcaaagctaaaatgaaatatcacctcatacgtgttacgatgatattctcaaaaagacaagagataataagtgttgtcaaggatgtggagaaaagggaacccttctgcactgttggtcggaatgtaaattggtacagccactatggaaaatagtatcgaagtttcttaaattaaaaatagaatcatatgatcgaacacttctacttctgggtatagatccaaaggaatgaattcagtacctcaaagagatatctgcactcccatgtttgtttcagcattattcacagtagccaaggagggaaaaaacaaaatttctgtcgacagaagaatggatttaaaaaaatgtgaaacacacacatacacacaccatacacacacacagagagaatattgttcagacattaaaaaaggaaatcctgttatttggaacaatatggatgaaacttgaccgcgttatgctaagtgcaataagtcagacagagaaatataactattgtgtaatctcactcatatgtggaatctaaaaaagccagattcatagaaactgagagtagaatggtggtgatgggggctggctggtgggggaattgaacagatgttggtcaaagggtacaaactttcagtttgaaggtggattaacttctggggatctaatgtacatcttggtgactatagttactaatattatattatatacttgaaatttgattagagaatagatcttttttttttttttttttttttgaaatggagtcttgctctgtcgcccgggctgaagtgcagtggcgcaatctcggctcactgcaacctctgcctcccggattcaagtgattctcctgcctcagcctcctgagtagctgagattacaggcacgcaccactacgcctggctaatttttgtaattttagtagagacggggtttcaccatgttggtcaggctggtctcgaactctgacctcgtgatccactcgcctcagcctcccaaagtgctgggattacaggcgcgagccaccatgcctggccagagaatggatcttaaaagttctcaccacacacacacacacacacacacacacacacacacacacacacacacacaaaatgtgaggtaatgggtgcgttaaccacttttattgtagtaatcattttacaatatatatgtatatcaaatcatcatgttgtacatcttaaatttatacaattttagttggcgattacactcaataaagctggaaaaatggaaaaaacaaagaataaatacaaatggttaataaatataggtgaaaagcaaaagaaagaagtggtttgtttcacttccataattgttgttatgattgattttgcttctaagttttactgttttcttgtgtaaatgtcattagagtcccagatagaacttctgctctgacatggcctcctctccaagcctggtgacctggactggaaaagcccgtcagaagtcccaagatccccgggatttttttgtttaatcatggagcaagtgagactttttctgcatctcatcaaaccctgacagctttctagaatcaaatctatctcccaagtagaaaaagccccaaatccacatgaaagtgaaggtgaacaaacaatatcatttcactctcttccttcttttctccctctttctttttttgttttttccaacaaaacatttttttatattttcattacacaaatggtacgtatcaatgtagataaatcagaaagtaaagatttgaatatatctgtacaaggtaataatatgcagctgttgaaaagcatatttttttaaaaaacataaggcagatctatgtgtattgacatagaaagatgttcatgacatactatttagtgaaaaaagcaggttacagcacagtgtatacagtgtgatcctatttatattaaaatatacacatgcatatatgtttatatgtgcatacaaatgtctggaaaatatatataccaacctgttcacaatggtcctctctggggaatggggtggtcagagggaaagcctctatatacttttgttgggtttgaatttttacgacaagcctgtattattcttataattaaaaaaaaattctaagaaagtaaaagaaaaagtaaaggcaagaaaagagccagtatggatatttctatgttgaaataaaaatatcaataagccaaaaaaagtaaaaaaggcaatgcataatctctattccctctcaaggcaatcattgttaatattgtgctgcatgactcaatctgtttttatccatgtaatatatacatcatttttatttacataaaataaattatattatacatacaattttcttgtaacttgtgtttctcacctagtgatatctcatgaacacctttccaagttgatgagaagacacctatcttattattttaaataaatgtatatttacttaggttgtttcctttttatacccttattaaaaacaagactactgcaaacatccctgaccagttatatctttccacacattgtgtctttaggataagttttttaaagtgacactgctgagcacagagatgtgcaatatttgttaaggcttttactccatgacaccaagttgccttccagaaaagccttgccaccgctccctcccatagccgtgtgtcggcaggcctgatctctgctttatctgtcccctccatgagttagttctcgttgaaatttttgttcatttggtagttgaaaacaatataatctctgtgtggttttaattagcattcccttgattactactaaggccgaacatttcttaatgttcctagtaatctgtttgtcttttcatgaattgcttgttcatgcatttttcctatcttcccactggagcgtttgtctttttcctattgatttgtaaaagctccctatatattaaggatattagtcactgtctttcagatgtgtggtcattttccaagtacattattttggcttttaagtttatcaatagtttttttttttaatgcacaaaagattttaaattttgagtcaaatttatcagtctttttcctttatagtttctgtgcttggtattatatttggaatatcctccccactccaagcctatacaaataggtaccaatattttcttctagtatgacattgcactcttcaatccaccaggatgtaatttgagggcatggtgcaaggtggaagtttcaatgtcctttttagaaatggctagctagctgtcccaacaatctcactgatggtcccttcacttcggttctgttgggaatgctatctttatctcatctactgaacaactcttgcactggggtatgttgcaggacttgctctcctgtttctgccatttggttaagactagaggtttggaggcagctcttgggtttctccagagctgtgagtcacactggccctaagtgtgtgcactaggggtggagaggtagctacaggagacaggctccgagggggttgaatgtacagccatacatccagaaatgaacttctccaaatgtagctcaccctggtaccaaacctccaaagtgctagccattgcccagctagcccccaaagcccgcagagacaaaaactctctcctctggctggcgctggaagcctctaggtggcactgcggagccgttctgtgccgcctggagggcacaggctgggatacgctccggggctctttgggcaccctggtcgtcgtggggctccaggaacctgggcaatgggatgcagggagaggttgctggtggtgaggacaccagcttggtttcgccgcagtccttggcacggaactacacgccgccttctttaaaagggcaggtgtggctgaggctccacggacaaggccatcatgaaggagtcacagccgaggctctttataaatcaccccaacagcagcaggaaggacagttcgctggctagttcgcctgccagctgaccttgagaactaggccagacaggcgaagggcggggcgccggaaagggctgggattggtaaggacactcagcagatgctctttcaggtgctcaaggcagtgcctctgtcttcacaatttgtgttagataaggtctttcacagccaggaccgcctgggggtaaggcagctccaagcaaaatcatctccattttctacatgtctaaggagagaccttggtacacagctcaagaacagtttgttcaacgaacaagtgggaaaaactcttgtaggaacttaagcaagtttctgtccctctctgatactgtcttttcttaccggacaactataaagtcatgccaaatatgaggatttaaaaacaggattgtgctgtgagtgcatccaactgaggctcagggaaaagcattccagttgggaagatctagcatgttctcaggagtgtatccaggcacaggtttcagtgtggctggcagtctagggtgcatgttagcaaggggtgggaagcaggctaggagaagaaggcgggagtctgatccatgctggatgcagggttcaggggcttgctccgccttcaggtcccagtaagggctgacagcaggaaagagcagattagtcctctctttgcaaaatgctttgaaaggttgcctctggctgcagcagggaaagtgtgttgggaggcgggaggtgcaggggtaagagcagctggaggctgttgctgccctccaggcaggagatgaaggtagctctccttggacttgagatatactttggaggtagccctaggatttattgattgatagaatttgtagggtaaggaaaagagaagcattaaggatggaatctagattttgtcccaaatgtggcaatctctctctctctctctctctctctctctctctctctctgtctccatataagtatatgtgtaaaatagtaaaatacgtatattttaatgtgaaagaataaatcaaaaagtaacaaaaatgtgctgcctgtaggtgaagagaaagagagaatagagaatggggagaggaaacagagatggaagctaaatttcttttgttttatactttggaacttacagccatttaatatttcatacaatttaaaaacaaaatcaaatcaaagagaaaaaaacaatcccataaagctgaaaacaaattcaaataaatgaatctttctgtatatcaagttgatggcataatcatacaaaacagaataatttgaagacttttgaaacatagtgttttgactgtatatccctggtggaatatatattgaagacaaacagaaagaaatgttaaattacatttagttttttgttagtagttatgatggtattgttatttcagcacacataatattagaataaaacaaatgatatatatgttaatgccattaggaaaaatgattttcagcataagagaaaaatgatatccattacagataaaagatattaagtaaaatgcactatagtctttttcattaattgaaattttcagtatgaactccttagtttttgctctccaaaaggtgtaatttttctagctctgtccactgaaaagacaaagatataatgcaagccagtaataaagaacattcctaatgcccagctagtggtctttaaatactatttctcattgaaacacgccagagctccttgaaaatggtttattccaggtctctggaagaaaatatgcaagatgagctgaagatctattgtgctgcctaaaattaccaaatattactagagtcaaggctaaatgacataggaggaaatttactgataaagccagaattcctttttgcagacagaccttttttgctgagaacaactagaatagctaaacaagatttggggggaaaaaatacatttgaagacagtagggagctaccaatgcagcaaggactaaagagaccaagatgccagaaaagaagggagacagagaggtgagcctgacatttgacacaacttttctactaaaagcttttgccaattccaagcagtggctaagaggccagggggctgagtagatttccacagtcttttgaggttggagggacgaacattggcaattagggcccaccaaggagcagatcttgtaaacaggttttaggttgggatcccttaaagggctacaactaggattaggagtgaagaagaaagttactaattcttgcaaagattgaagcccagccttgaataagctcacgatttccttagatttaggtgatctgctcctacccttattacctgtgagaaggcagagtaaattctcttcaagaagacatcgtctggctcctcagattatcttttgatatatgcataaacaaagtctagtatttaattaaaaattatcaagcataccaggaaacaaaatcacatgtcccaaaaccaagagaaaaaaataaatgataaaatcttatccatacaagatacagcttttagacttgtcagacatgggctttaaaataactatgattagtaggttccagaaatcacatggctaattaaagattatcaggagagaactaggagtcatatagaaaaattaaatggaaattccagtactgaaagataaagtaactgaaaaaactgtttgatatatgagtttagcagcagattagacatagctgaaggaaggtcaataagctggaagataagttaaaagaaaaaaatcataccgaaacatgggcaagaagaggctgaaaagtacagagaggtgtataaaagacacatgggcgacagttaaaagttatgtatattggcttatgtcaggtggatagcctgcattcactcacctcttaattaattgtgggaaattccttgaagaattcaagactctccttcctatgtactgtcttaagggaaattgtcgtcaatgaactcctatgataattccgtcattccatggtgtaagaggattgcagtctgcatgcacggaattaaaattggaagcaagtattgacatcaagtggaaataataatcttgaaagaaaagaagaaagaaggaaggaaggaagaaaggaagggacggagggaagagggaatgagaaataaaagaaaaaagagaggaagggacaaaggagaaagggagaaaagaaggaagagaagctgggaggaagggagggtgggagaaaatgggaggaagggagggtgggagaaaatgggaggaagggaggaaataagcaaacccatctgctgcagtacagcatctaccagctggaacacaagacacaggcactttttttttttcataagttctgggatacatgtgcagactgtgcaggtttgttacatcggtatacatgtgccatggtggtttgctgcacctgacaacccgtcatataagttttaagccccacatacataaggtatttgtcctaatgctctccctccccttgcctcccatcccccgacaggccccagtgtgtgttgttcccctccctgtgtccaagtgttttcattgttcaactcccacttatgggtgagaacatgtggtgtttggttttctgttcctgtgttagtttgctgaggatgatggcttccagcttcatccatgtccctgcaaaggacacgatctcattcttttttatgactgcatagtattccatggagtatatgtaccccattttctttatccagtctatcattgatggggatttgggtcggttccgtgtctttgctattgtaaatagtgctgcaataaacatatgtgtgcatgtgtctttatagtagaatgatttatattcctttgggtatatacccagtaatgggattgccaggtcaaatggtatttgtggttctaggtccaacataggcacattttaagatttgtactgtcaccaggcataactatacagctgctgggaacttgaaaccctgcaaaatatttctaaatatagaaccacagaatgacagagctagaggggatatacccactttacagatggaaaacttgtggcacagctctccagttgttctgatcagatagttagatttttcccctgaacagcatcctgggcagaaggccagaaacatgtccagaggattgatgagtagttggggagcctgggcctcaaggaacagttaatcctaaaggcggtacccaatcttctaatttcctgctcctgagggataaactgcctttctggcccccacttgcttccatctttagccaaataaaagggacacaatcaagcacataacattaaaaaggaaagacccgagaagtgagatcccaaaggatttaaggcctaagccacacaagaatacctccatttgtctaattgctctcagaagccctgtttcaatttgtgtctggacctgaagaaaactaactattaatcactgtacaggtggccctgtttagaagaggcatgtcttctttgctgcctaggagaatagtttaaagattttcacaaatgaataattgctcattagaaactaatgcattcacacaactgtgcagtcttaggtaacaaaaagtcatgctttttgaatgttcagttgcttgagtcctctcctaaaaatcttatgtggttatccagcctgggcttgaattcttcaagggagcttgccaccccctggagtagctaaccaaggtaactgtagcctctggggattattggtatgaagaggtgcagggggaggattggagtcatgtgttcatccaacagtgaaaggtcagttttttctcttttttctttttctcttgggagaaatgccatggactttcttggtctctgcatcttatttgtatgtgtaacagcaatgtacccccaaagcattgccagtctgtgtcaccaaccagccgatcagcaatcagttccaggctggtctcaagtcagttctttctatggcacatagaagaggcatgtcttctttgctgcctaggagaataattaaaagattttcacaaatgaataattgctcgttagaaactaatacattcacataactgtgcagtcttaggtaacaaaaagtcgtgctttgtgaaataatagatggtatgattgaattcaaacagttgatagatacttacaactggcttatacatgtattcttaggatcaaaggcttgccatttattgtgcctgaaaccataactgtcaccataaaagattatgcagctttggcacttatttagcaagtggtacataattgtggttactactcagattgtccattcttcactttagagatgaggttgttccattgaaatagaacctggtatccatgtttagttcttctaaaatggggtcctcacattagtaaggattattgaatgctgttagtggatggtattgcacagtcattcaatcattttatgggccctgatgataatccagggcattcagagactctcaacggaggcaagatctttctattttcactttgataccattagaccagggaaggaggtgatgacagtgtggctcatgtttgaacatgaagcatcccatggggtccttagactgtgaaccttagtggcgaggaactagttcatttcagtctgaccccagacatcccagcagcagtgtatgattttctgcagctttcagacatccagatatggaaaaacacatcaggagccaggtatttgctaaggggtgaaatagaacattaagaaggaagatttgaagatacataatcaaacctggctctccactgtataccctgaagctttcctgcctccatgcacttgtccttcacttgaatgatttccctctccttttaccaagtttaagttaaaatcaatcacccttatttgaaggatcaactcatatgtcgctccctccagtgagatttcctctagtgactgacaactcctggaggagcgttcagttttggacacatggggttgaggtgcttaagaaacatatgagttaagatgagcaaaagacagcggggtatgtggatctgggttctcaggagagaggtttagattaaaaacaaatatctaaaaatcaccagcatataggtggcaattgaaaccatgagagtagatgagagaggttgcccaaggagagtatgtagaccaagaagaggactatgtgtcatgtaaaagttgaattcatagtgcagaaaaggtctgttccttatctcaggacaatgtgagaattgagtaagtaaaaactcagacagctacacctaaaatcttggatgattctaataatgataacactagcttgtgtatactatgtattaggcactctgctaagaatgtttcatgtatatctcagcaaaattctccacctactgcctaaggcagatactaacatccccatttggtggatgaggaaattgagtcacaaagaggtcaagtaacttacccaaggtcacacggccagcaaaggatggagataaaatttgaacccagttctgtggaatttcaaagtccatcccttgacaactgtgacatacatgccagttgcctattgccatgttaaatatattattattgcatctgacctgggcaagcctctgtcactggagtccacctcaggggtaagacaatgacaataaactaagaaatctataggtgctacctgatggatgagtaacagagcaagaagttccatacattctaagccctgtaactaagtttcaactaccctgagagtcacttccaggctcccctaaccccctctcacacatggaccactatagaaagatgactctcagtctctcttgatttccacagtttagctgacttctatgtacaggccagagtgagtaggtgacaacaggagataaagcgaagaagattgttgcactgaagtgaaccacagagactttctcaaattgagtacaattttccatgtcttcaaatctttgctgaattatggaaaatgcaactcaatatcaaaaagggaaagttgaaatattttttgggttatggacttctcatatccctccagtaggaatgaacttctgctttccctgggttcccaaggcacactgcttttatctccattgatggctcttctcacagtctaccagggattccagttatttgagtccttggtggtctcccttaatagattatgaaccccaagatggcagaactctgtcttattcaccttggtagctcccacagaagctatcactgtgcccctcacatggtgtggtgagtgaaagaagcactaaggaatgttgaagtaaggcaaaatgttgatggctatagtgcttgctgttcctcagaggagtctatggaaggttgtcctgatttgtggggacccaagccatcatctcttccttacccttactctgctctccacaagctccttctgctttccccattcacagcattactgtatcatatcatcattgtctatttacttgtttgcttatcctatgggctaagagcaaattaagggtaagggccttgtttgattcacctctgtgcccttagcacctggaatatagtgcctaatgagtgtataatggatgaatgaaccaaaggaaggaaggagggaaggatggaagcaaagaagaaaacagaagcagggagtgaggaaaggaaagaaagatgaaaagaaggaaaaaaggatgacctgagaattataaatctcttgaattggcagaagagtagtacccatccttcccccctaaacagggaagctaagaaaaaaaaaactaatgtgggtgggaagagggggaagtggtcactttttctgtaagatgaaatacttctgacttttgtaagaaattaaaagaatgccagtttacaagtagaaatgactgtgatcccttgattatacaacaggaaaataatacagcatggattgctgtccatttacatgggattcaaatttgtccagtttaaaaactccaatttgacaagaggttttcacccactcagtctacatggaattgatgtagagtgtgtggtggggtgtcagccatcactattctaaaacttaatgctacttaacatcaagtcaaaattgctgcttttaggtatgtgaagtgttaagcacagtgtaggtgtttcagaaatatttaatgattgattaataggcagaaattgctccagaaagaacatgtcaaatccaaaacttagagaaaaatgacaataggaaagaatgcctggatcagtaaaaaaagaacaggttagaaaggaagaaggacagtgatatagcaagataaactatctccttgaaatcatctacattccatttttcttgcaatcatatggatggaatgggacattagaaaaaggaatctgatgaaggtagtcccttttgttagtgaaaagtcaaataagaggaaacaagctttcactgaaacagttcttgttttgataagacataagggaggactttctgaccatcaggaacactaaagagtttcactaaataagttatggattattcagccatggatatcttcacaacagaaacagaccttcacacattcttgctagttcagcctgtcactgtcctggagcaagtgtagtgcttgatggggcagcctaatttagggacaatgcactgcactggaggtccaaaatgccagattctagagccaaatcatctacttaccaatgacatgtccttgatcaaattctctaactttgttgaacccctgtttatttaggactctatacatcatagggttgctgtgaagaccaagtaagagactatatacgtaatgctttgtatctgcaaagccacgtgtggcttttaattattatttttaattctagagtttaaaataataatcacaacccttatctgaaattcacaaagcaggcagcaggcagcctttttaggataaatgctaaagtccaaaccccttgccctggtacagaaaactcatttcttgtcccgcccccaccactgtcaaacctgacggttccctaagtgtactgaaccatcatcttctccatgaagttcttccaggatgtacgcttccagatagcacagacattctcctcttatgtattctctgtgccctatgtagatgttgcccctccatcggacttctctgtttacttcgtctcccctactagaccagaagtcctttgtgggcttccatccttgaatctaaccaatctatttctgaacatgcccaatgtagcatccaacatatcaaagcaacacaattagttttcatttgatattacattgtgtagcctgtacttgtaccaatatgtttaccagcttcttgtccatcattgcttcttgcattccactcatttctcagtttaatttctgtgcttgagttcatattttagtagatctttaggcaaatatctatgtctttgtctcaatgttttatgcccaaggtatggaacagcctgacaatagtgtgtgctcaataaataaatgaacattaaatgaaagaataaagagtaagctcagtctttgtctgactgttctaggttctttgtatttccatgtacgttttagaatatgtttgtttaattctatcaaaaaaaagtctgcttagattttgactaggttggtgttgaatctatagatcaatttgaggagaaacaatatcttaatattgagtcttccaatacctgagcatggcatatttctacatttatttagattctctttaatttttctctgcaatgttttgtagcttcaacatggaagaatggcatatttcttcgttaaattcattcctaagtattttatggtttttgatgctattgtaaatggtatttttaaaagttttatttccgattgtttgttgcaagtatgtatgtgtattatctgttgctaaaattttgcatgttgatcttatatttgtgactttgctaaattcatttattacttctaataagtttttagatgtcttagaaatgttgtgaatacagtcatactctttgcagataaaaacggttttacttttttattttgtatgcttttctttttttgccattttgcactgtctaggacctccagtgcaatactgtataaaatggtgagaatggacatctttgtcttgctcctgatcttaggggcaaagcatccagggttttactatcaagtatggtatttgttgtcagttctgaatattcagcctttatcaggttggggaagttctttctattcatgatccactgaggctttggggcttgtttgttaataataaatagacattgaattttccagatgctttttctgaacttattgagatgatcatattatttttcttttttatttagttaatatggtaaattacacagattgatttttgagtattaaaccagccttccattcctgggataagccctcctttggtcatgaggtattatcatttttatatattgctggatttgatttgctaattttactgaaatgttattcacttgacaatgtattttgctctacttctaaatgataattaaattgagcatagaattcaaggttgacggttttttccctgagtactttgaagatattcatctgtcttttagcatctgttttttgatgaaaagtctatattcagtctagttgtcatttcttcaagggtaatatttatttttttctccctggaggcttttaagatttttttcttcaatgtcctgaagtttcatcataatgtgtctaggggatagatttgtttttacttattctgcttaagactcagtatgattatttcatctgagcacttgtatcatattttcaataattggtctttattccttcaaatatatcctctctctctctctctctctctctctctctctccctctccctctccctctctctgttcatatcttctcctcctggatcacctactagatatgttggctcttcttattctattctctaaatttcctaatgacactttcaaattccccatttctttgtatctctttcttgcattccaggtgattttcttagctctatctttcagttcactgtttctttctttagcagtgtcccatctgctatctcatccactgagtttttcaatttaaaactatgtttcattttgagaagaaccaggattctttttcaactcttattttatcaccttgtcctgttctttcattgtggcttatttttatctccgtcattattttaaatatatgtgctttacagtttctttcagattgttctattattctaagattttagctagatagttcttctgctgtgtctgctgagtctctctcataaaggttcattttcttgtgtagtttgcaatttttattttagggtgagggcatatttagtgagggttacttattatgttagaggacagtgtgccctggtttgtgagtctctacagtcttggtgcttccttttgccaagaatcccagaagtttcattggttttagaccagctttcacaatgatggcctgacttgtgattcctgtcccatgcaagttttataaattctgaccccatttctatgggaagtgtgagatttctcataagagacatttctcatggggtccctccaaagcctgggtgggcatgaagcttccttactccttctctgggtgattgacttttttccagtctatgagaagaaggactcttcaaggttctggcctttatgcaaagaagtgattctaactcctctacgtaacatggacatgtcttccaaacatatgtcctctctatgcctgggacccaatgcccagcacctggcacttatatcaggttcacattttctaagtactactccaagatttacttatacttattgctctgcatttattgtttctctgtatttgaggtgattagaaatttttacatttttttcttcaaattttgcaatatattttattttttataagaattcttttttagaaaggcagaaagaatagtgtaataaatacccaaacactcatattcgatatttaaaagtatttttttcttgccacatttactttatctattagttttctgaaacatttcaaaataagttgtagccaccatggcatgtggcctccaattagtttaatttgtatttcctaaaaataaggacattctcctatataaccataataccaatattatacttaagaaaatcaacctattatcaagtagtattcaaatttcataaattgtttccaaactacattgtatagctgcttttgaaaaaatcaggatccaaagaattacacaccaatgaagaaagacactttttgttatgtcttcttattccattttaatctagaaccatccctatgacactgactttttgtagaaaccagaccagccgtgttgaacgttctccagtgttctagctttgactgattatttctttgtgattgtttaacttgatcctctgtctctatattttctgtaaattgaaaatcaggtttaatggcttgacttcttgcaagaatatttcataggggatgctgtgtgtctcctgttgcatcacattaggagatctggttgtcccattattaagggtgccaagattgctgcctgggttaaggtgatgacagcctaatctctctactgtaaagttacatttcccccacacacacaccttgtaactaacaagcaagtaatttctgaggtgtgcaccaagtattaaaaggaatttggaattgtgttttatccatgtttctatgaatttgtcggaagagaagggatcccatcaccttggaactccctgccagtgagttccctgtccctgggcagacactgggatgggtgggtgctcagggaatagtgagacaagagggacacagtcctcctgaaaagagctcacagcccagttggggagacaacacaaacccatacacagatatctatctccaacccccactgctctgggtggaatgaatcacctccttccttatagagaaaaccaaagcgctgctttcagaagaagttttgctttccctgctaggttcagcaaagcttccctgaggcccttcactgtgcagaaactgtgtctggccctgggaatagggagatgaacaaagcatgccccttgccctgtgagggcttgagggctaattggagagacagacacataaacagacaattgcagtccggcatactgaacactctaacagaggagtaaacagtgtgctgtgggaggtcagaggagagagcaattaccaaagcccccttccctacaaagctggagaggcccccagccctgctactccaggtggaagtgagcactcctcctctgaatggtacttagcatttctttgggcctcccttatgctgcttcccattgagtacattttcttactgtaacttacacaaaaactgtgagcttcttaaggatagaaattcaaacaaggtttcccacagaaacatgcgttctttctgatatgctctgtaacactttcttgggctgtgctatagtctcgctgccccctacccttgaagggtgatcgatagaacaccccacagcattctaaatggtgtttgcccggagcagagggcataagactctccaccttctgcttaactggacactccatgtcatcaataaaaaggcagccaaaaagtgcattcactttggggtaaccatcttgccttgttatttcaggttaaaccggctatgaactgggacactcagtattttcccccctttcagtcacgtgaataaccttcactgtagctgctccagcctttgccctcaaacttctgaagcaatcaaatccatttctgattaagaattaaacattttctgccctgcccaggctctgctaatccagagcaatgtttagtttattgcctttcaggcttcatgtttttttgagtgactgagtgggcagacatgtccattcactgtggggagtttcctggaattagcagtacagtaaagaaaaaccttggcataaaggcattaaggcaactacagctaaaaaataaattttaaccacagtataaaaggaaatggttaatcccagtttgcaattaatttcagcctctaatcaattcctcctgtgagtaaagcacatgagaaatacgatctccaaacgattaattcatagcgaaaggtcacttctttgaggtatgagcagtgtctggaatctttccctccttacaggtctcgacagtagtgacctgagcacgttctcctcctgcttaggtctcaactttaatcagggaatcacaatctattatttattcttcacactgaagaaaagggaatataaacatgtgggtttggtgtcacccatagatcaattagaaaaaaccgaaaaagaaaaaactaacagattcctccaagctgagtagtcttcttgcagtttgtgccaacttcaacacagcccaaatgtttattcaataataaaatgggcacttctagaagaaccgcttatggctaactagaaaggtagcacttgagctatcattttctcaactgatttcggaataaaatagatgaaggtaaattctttgtgaataatgactttgtccttaccgccttccctgctcatctaatcccaggagcagagacggcaaaacggggagcagagagagagcgtctgagacagagatgccaggagctgtgtggctcagcatgcgtcctttgcaaggcatgctgacccctctaaatggaacgatctttcgggcattttcgggactgcttgtgaggctgatggctgcactttggaaggcagcctcactgtgcttactatgggggcccctgcagagcccgtgcacagcagttctgggtgccaggttaccagtggaaaccaagaagtttgaggcgattcctgcacatgattcaagccaaggtgctccttaatgaatggctggccccagctcttgtgtcccatcgttgggcccttcaggcggctcacattttgaactgttactgctcatcacagaagagtgttctgagaatgtcccccgcctcctaatagcattaattctcccacctcgccccgaccaccaaacaaacagaaatgtgaaaagtattccctctgggtgaagtaacttctaggatagcttttggtttaaggggctgtatgtggatggcttttttgtttgttttgttttgttttcttttgcagggtggaggggaaacagaagccagatactctctgtctgtgctttgctgtgtatgggaaacatcctttctgtggaatgctggcaacagggagcttgagttcacattttgctgttggcctgcagtatctcacaagctttcaagaagccttcagttgaggacccaagagaggctactggatgctgattttgaaccgaggatgtacactgtccctgtgaaagtgacatgcagggtcacggtcctgggatggaagctgcagagtagatgaaggcataggatagaccatgactattctgcccatattgatgctgcctttagatttcatgcaagagatacttaccgatgggaccatcaaaggctggaccttccagcaaactggctgcagagctagaattatgactcagctttgctgactcccaagcccatgctctcccaagcttatcttccagcaaggggtcagtgatgttcagattcaaacttcctctttttgagtagtatggatatcctcttctcccaaaaaaaaaaaaaaaaaaaaaaacacccacccatcttagacaccctgaaagcattatcattatgtaaaacctgacagcaggagggtggtgcatttctcataaacactttttgtttttctaaaccttacattaatttccagtgcagatatgtccatgggctatagcaggagacaatgtctttgttgggaaactttaattaaacttctcacagggcatagtgaaaatgcagccctttgaaacctgagacctaccagcataaagatgaaagctgttacgtgacacaaaataagacatttgtgaatagctcaaggtttttccgcctggttcccctgatgaactgataccattgctatatattggcaacagtaaactctgaggggatggcatgggagagaatggagaatatattttgccctgttctagaacaacaggagtgaagaagctgtcaccatggatgctaaaatgttcggagtaatatggtccaatgagtctccaatggtgaatggtgatccagtgtcgagctgataggacttaagaatacagatctctgggcacatgccagaaggttaaatttggcagaggctggggtttgctcagttctctgtatttttatatgtgtgttcctggtgattctgacaggcagccaatttggggaaccactgactgatctatcaaactcgcccaactctgccacttgagtcaggggtggagttcagggcaaaagaatggatttggagagggatacatcctgagcctacagggctggtgcattcaaagatttgggaactgttgttgggtgcaggaccccaaagtaggagctgctctctttggaagagtaaaaccatgacaacctcagaagagagtctgggtctcctccagatgacactcagcgtgtgtacaaagaggagacatgggtacacattggtagaaaaagcagaaagctctcaaaagtggccttagagacatgggatgccacaaatggggaaactgaggtccaaagtgtgagacaggctcagctcagagacccatgggcagcaagcaccaatgttagctaaacttttgcttcttaactcgggatccctgcaccacaccacagtttaggcttgtgtaatatacgctccactttgctcatttgttcatatgtcacgaatattaatcaagtagtctagcagaaggtgaaggcagaaaaattagacacagcccccaccatctaggtacttcctggctattagaggaaatggctgtaacacaagggtgagacaatgcctgaggagtgatattgacacagggatggagaaaggtgcttcggcctggcaggaaaccctggagtaagttgggatgagagacatcttcctcccagaggtaacttaaataatctcatcatcaaactccctaacttcagagctaagccttagccctaaagtctaccaaaggtggggtgtagaggtgcagagagcagaggcaaattgccagaggtcgcacagccagcaagtggtggagccagggctccatcccagattatctcactcctgggtggtccagcgctcttacctcgtttccacagtggtgatgaattcacagaagaagaaaccatactgagaactttgttgggacttaaaaatctggatgaaagaaaagagctttgttttcctagattaattaatttgtgtccttaaccaagggaattctcatgaaccaacacatctcagatgggtagggaggacaagggattgccctgggtatggtggctacaggcgtaatcctccatacaagtagttatatacccctctgcactgcatttgtcaaaaacagccctttctgagtgtttctctctaacagatgggttttatcttcaatgaccaaacaatagaaagcagggcagacataaggcatctttttctattggatttgttgctgcctgtggtggagggtgagatactgcagataatttaataaggtctgtctgattatgtttagttatatcatgccgctctacttgccactttccctgtgattttcctgagtctttcctcatttcttttccatcttcttatcataaggacaatgatggttataatgacaaatagttatatagcacttaccatgggcaaggcagtgttttaagcacttggaaaatacgaattcattcaattctcccatcaaccctataaggtagcttactgatattatccctattttacttattagaaaacagagacggtatgtaacctgcctagggtcatacagctagcaagtagtggaggtaagatttgaactcagacaatttaggtccataatctatggtctatactcttaaccacgatgcacagagccacttcagatagcaaagaaaaatagatggaaaattagaagacaatcctcccttgcaaacagatgttgaaattattctaaaacaaaattctgatcttctgactacatgcttatatctatgactgaaagagaaaaaaaagcaaacctgacatctgacttgattgaccctcagtttaaatgaagagcccaatgccccacctgggacagcaaaaacctctagttagtatttgctcaataaatattagatggataaataaattaataaatatatagataaaatttcctctaagcttatgtccacatcctcaaactcagagcttatttaaattgtgggaagaacatctggaagcctgaactcttgggtgtaagctccaggtccatcatttatgagctgtagacttttggaaagtcagccaacctctctgatctttacttttcttttctagaaaatgaagataataagctctgcctcacaggatggctagatggataaaataattgatttgaaaccattttatagatcaccaaatgttatctaagcatgagggtcagttagagaccccataggccaatcaaatatttttttcctccatacaacaaggagacctagaagcagttctttctgcctcagattgtgatataggccagtcctcttcccagtgccacactccagggagctctgttcacagtgcactccatgtgagtggtagccctgggtcatgtacttcggaggccctgtctagtggataaagtgaacagcaacggatagttggttgtgatttcctagtggtggccttaacctctgatggtaatggtggcactgtggattaagcaggtagccaggccaggcacgccatgaccctgtcttcagagaagagatgcgaagctcatagatgggaaatgacttgtccaaggttatgaagccagtaagtgattgggatggatgcagaacctgggtaccactttttactcatccaagagccctctgaatttgtgggagtaagtgcagccttcacatgccaaggcctgtgggaagggagttgtcgaagtagctttgaagagaaacgtgttgtggttttcttatatcgaaaatattgacagaattttgtttcatctgtgttagtttcatctgtgttagtgattttgtttcatctgtgttagtcgacgtaatttgtaggaatttgtaaaactaaatcttgtttccctcttcagtgagcatatattactaacttcaatatggaaagaataataactgagccacaggaaaacatccatttatttgaaaagaggtgagtcaaactcagagaacttgagaaataattataaactagctccaggtgttggcacctgagaaaccatgttgtgtgtgtctgggtgtatggggagagccactgcagtcatgcacatggttcttctggcctcagtctcccctcctctcttggaagagaggtctggccattgggttcaggtctcttaggaaacaaggccattggagtcctggggctgagacgtgagtcaaggcaggcctactggagagaataattatcccaaatgaatgttactacatctgggggctagagtagggaagtggagtgaggtcagcaattcctggtgtaggagacatggaaattcacatcgttgtcttaattcaacttggctttgaccggcgcaaagcagtttctccagaagcaccaccaacggaaaagtaaagaggctcaattgtggaagggtcctcagagaacacatttcctaatcctttatttcacaattgaagaatatcgagcccggagagggaaagtacatatgctttggtcacacaccttggtagtgcctgagctgagatgagaacccatatctgttgatgtccaagccaaacctcttttccctgtatgtacctgctaatttagaaggaacacaaagccaggcatggtggctcacgccttaatcacagcactttgggaggccgaggtgagcagatcacctgaggttaggagttcaagaccagcctgggcagcacagtgccaccccatctctactaaaaatacaaaaaaaaaaatagctgggcatagtggcaggcacctgtaatcccagttacttgggaggctgaggcaggagaatcacttgaacccgggagacagaggttgcagtgagccgagatcgcgccattgcactccagcctgggcgacaagagcgaaactccatctcaaaaaaaagaaaaaaaaattaaaattaacagaaatggaggtgtggagctgaatgccctcttgttcattaaaacactcattttattatgaatggagaaaaaaattttccagaagaagattgtaaaaccatttttaaaagctttcactatgattagtagcaattatggcaaacaccccagctgtagcatgatgagagtgtcagaactatgccttcaatgtctgggccttgacctgtccacattttggcccactgagcagtagcactggatatccatcaggcttctgaacactctgaaaggagctgggcagccacaccaacagtgccaatacaagtagtctccacacagagcgatgtggaacgaataggaaactcaaaattcagggtgaagtggctcaagtagtgtccctccaaaagatatgttcacctggaacctgtgattgcaatcttattcggaaaagcggtctttgcagatataattaaacaaaggatcttgaaatgtggagatcatcctggatttagagtgtcctcataagagacggaagaggagaagacacagacagtggagaaaaggccatgtaaagatggaggcagagattggagtgacgtggccacaagaaaagaatgcttggagtcaccagaagctggaagaggcgaggaaggattatcccctagagccttcagagggaatgtggccctgccaacatcttgatttcagatttcaaacttctagaatggtgaaggagtaaagttctgttgttttaagccacaaagtttctgatattttgttacagcagccctaggaaactaacaacaggggtaggtgcctaactggcagcctcagcaagagctgggcccacctgggcacacaccaggcaacagaacccctgtgtcctgaggcaggagccagcggcaacaagactgtgacaccaagtcctccttgcttcctcctaccttatacccaagactcaggtccgctaccagtggagagcaagactcccttcatgtcccagtcattacaactgaatctcgtgtccagggccatgggcttgtcttgaaatgcagcccggttcctaagacagaagccatgccctgctcttgtcaggccttcccccatggcctgagtccttccttcaaagctaacatgatggctgaggcccgtctacctgctgagaaattaatcagatgcattccatttgactagtccaaaatgaattatactttgattttcctaacctctttaattaaatctaccaactaaaatattaaacagccctctagatctacctggcaattagttttggttttgacatcctctaaaactcaaggcagatgtttcagataataatatcaaatcctaatctatttttttcctctccccaccaactctttttacagatcttagctgcaaacatgactattaaagaaaatctgatcaatgtgtcctgaggcttgctggttcctcaatttcttgtggctgggccatggctacttggcagtatggctaccacttgaggtctgactccccagtactgatggcttgctgttttcctggtaccgcgttccaccttcctaactgtttctggggctggccctattctctggggcctgaagcttcagttagtcctgctggcactggatgggagccatcacaaggcatgacaatgcctgatgcttctgtatgcagtttgtagttagagctctattctgaggaaggagaaagacttaaatgaggttatgggaaggggctgtcaacgactcaattgctctgctttattctgctagtgtaattttaatcacatgctgtgtttccacagtgagtaaccaaccctgctcattagacaaattgctctttattaaaaaatgctcatttacttagtagattacagtagcactagggaagtcactggagcccagaaagcagttgcacccatgctgcaaaggatgtatgtccatcattgcaaatattagcagcttcacactttaaagatatctccagatgtcttaggtgacccagttcagctctttcatgtatgaaatgcatgtctcgaatgcatattcaattatgatatctcaattatgcctatgtgctcaaagaagaaccataatttcaagaggctctatctctttagaaaataatcaaataccataaattcaaaactttttacatagagatgggatttcacctgagtgtaagctagtttatgccaaaaagcttaggtggggacatatctgtatatacacatgttccacccaaattgtcccatttgtccatctctcaagttaggtttaatgtgtatgtcataattaaattagactttgatcataattaaattagactttgatctttgtatttattggttcgaaggtccacattttaacttcttctgggacttgactgtaacaaaggaaaaaggaaaaatttatggatattaaagtaccatatgcaggcaagattcataatctgatactctgctccccttagctgtttctgaggaggaattcatttgtgcctttgactttaactgacgaggtccccaggtttgaagaacggaagcctttggagagcagcttccagtttggtttcatcaagtggggccaggactagggtagggtaggggagacactcaccttggctgcaaaatttaaagggacacccaaaacctcagtaattaaaataaattctattttgatgcaatattataaaactcaaaattaatgctaaaattccatgagcaaaatatgaaaatttaaaatcaagacagaatccaaccctgcacttgcacaaccatgcctcatttgtctcactctaatcctggccctatgtctgataaaacctcatttacaaaaacaagctgcccatttcttgggcatagtttgtcaatttgaatttttaaaattttgcattgaaatattatttatcttgactatccccttaaatcttgtgtgtaaggcaagtgacttactcacctcaccttagtcccaatcctgcaaccaagccaatcctcctaagcacattttttttttctattgatttctgccattggatgattgaactttgtgtgggtcacatctgaagtgctgttatgttatgtaaggttaggttaggttaggttatgctagtgaaagccacaagacttaggagttaaaaagcaactgaatgagccttttgaaataaccactgctggcacccagcagttgcattttatattacattgcaaagagtggcaggcatgatgggaacaaggcacagcatttgcatttttcttggtgcctgtgtaaccactgatactattttgtggctatgtattcatcaaagcaaccctaaattgaggcattattaaaaacaaaaaacaaacaaacaaaccaaaaacttaaattctcaaatttcaagtaagtgaaggaaccagttcattgcttcatcaattcaaccaggccagtcaaagcaggcagaaacccatgttctgagaattgatggcccggctagtaatgatctggatgaagtgcaagccacagtctggagacagcagcggaagcatgtgctgtggagcctggtacaggtctggtcctcaccagccatcgctacagctttccaagccccttgtgtccaactttgagtttggcaaaggaaggccatgacagcacactacaaagagcatgcgccctccgtcacctaggtttcctgcacaggccacactgttttacagctccaagaactcactgatgctgccccttcttttttttttttttttttttttttttaattatactttaagttttagggtacatgtgcacattgtgcaggttagttacatatgtatacatgtgccatgctggtgtgctgcacccactaatgtgtcatctagcattaggtatatctcccaatgctatccctcccccctcccccaaccccaccacaggccccagagtgtgatattccccttcctgtgtccatgtgatctcattgttcaattcccacctatgagtgagaatatgcggtgtttggttttttgttcttgcgatagtttactgacaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccagtttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccgtgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtctgatattggctgttggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgcccgtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctcgtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccatatcactttcaggtacaccaatcagacgtagatttggtcttttcacatagtcccatatttcttggaggctttgctcatttctgtttattcttttttctctaaacttcccttctcacttcatttcattcatttcatcttccattgctgataccctttcttccagttgatcgcatcggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgttgttttatctacttttggtctttgatgatggtgatgtatagatgggtttttggtgtggatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggatgcagtctgcccgttctcagatctccagctgcgtgctgggagaaccactgctctcttcaaagctgtcagacagggacacttgagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggtgtaggaccctctgagccaggtgtgggatatagtctcctggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcgctcgcgcacggtgcacgcacccactgacctgcgcccactgtctggcactccctagtgagatgaacccggtacctcagatggaaatgcagaaatcacccgtcttctgcgttgctcacgctgggagctgtagaccggagctgttcctattcggccatcttggctcctccccctcgatgctgccccttctgtctgaaatgctgtcttcctggtgtctcctggcttacttctgctagttatttaacattcagagcaaagttcaggtaaacatggtagaatggtcatgtgcatctaagtttcactccctcccagaagcacagtaaaggattacctacaatccctaacttacagtggttcaatttacaatttttcaactttaggatggtacaaaagcaacacgtattcagtatgctcctcagctgaagatggagtcacatccagataaactcgtaaactgaaaatattataaatcaaatgtgcattttcaatttaccatgggtttatcagaacacaaccccatcataagtagagtagaggagaatcagtattttttaaaacaatctcacagtgacagaaagaatggaaagggagacaagcataacagcatttcagaagctgagagatgaaccaggagtagctgacttagctgacccaaggaagctgaatccaggttggcagtggggatggctgaggagcaacgtaatctacatcacagagttttccactggctcaagaacaggcagccccagttacctcaggactggggcatggtgaagttattctcggagaggattgaacagagggtctccagactggggacaccaggaaaagtggaggacagtagcctctccacaaaacaagggattgtgtgaatgcatgtaacccaaatgttgaaagcagagaaccctgtcacctttgaccctcttggctcccagaacactggcacctgaatattttccctccaggcaggagactggaaaaattagactggttgcagcatcacatgcacaaaagggaaaagaggtggataaatctgtagactgagctcaggagtgtggcccttatggttcatgcagtcagtgggcactaaagggttttttcaacagactgtgatgtaatgagaggaagagataagggatgtggacactcaagatttttatatttaaatacatttgtaattgtggtaaaatacacataagataaaatagctatcttaaccatctttaagtgttaaccaccatccctctgcagaacttgttcatcttcccaaactgaaactctatacccagcaacgactaactccccactccccctccaccagcccctgacacccaccattctactgtctgtctccatgagtttgactattctaaggcccttccaaatttggatcctacagtatttgtccttttgtgactgactcgtttcactcaccataatgtcctcaaggatcatccatgttgtagcacgtgtcagaatttccttcctttttaaggctggacaatattccatagtatgtgtgtaccatgtttggtttatccattcatcatgagtggacatttgggcggtttccactttttggttgttgtgaatatgctgctctcaacatgggtgtacaaatgtcaggtttgttttgttttgtttttcatgtggcacttacacactgtgattccaaggaaggcttcattgcagtgacatcaacaaaagaagtcctttggaatctccaggtgttcccagcattccaaaggatgcaagatgcagttgcagctaggaggcagagggcatggcaatgactttaagctcttccaccactagtagcacctccagatgtgtgcttttggtgctattgcccctttctaagtcttaatttcctcctctgaacagggactcataaatctcactctgccatctacccaggactgttgagaggtcacaggaactaacacgtgcaagaaccttgtaaagtcaaaagtgtggtgctcatggggtgatgctgttgctgctgcctgagggagcgagagaacccaagtacaagggtagcagggctaggagcaggtgtgggcaggtggtgcaggtcttggaaggagatatggaaatctttctgcgagcaggaccctggggcacaggaagctttgaggtcagagtacaaattgagaaagttgcacagattgaaatgtcaaaagcagttgattatctcaattgctccatagctagcttgtccctttatttcttaaataaaagaactcaataaatatgcacttatggtaattgggaccacaatccaatagtattcaggggacaaatagaattaggggcctcacggagagagactctgcatgacatggtgacatcctctcttagggcagagacacaggaaataagggctttactgttgagctgtctttgcctgtggtctgctgctgggcacgtctggatgctgtcattatagagttatcttctcccgtcgtttaaggatgtaaaatcaaagctatgtgtctggagggaataagatacgtacttggccatgtcttgaacttctttttgtctttccttcaattaaaaaaaaattcgctgctcctttactgtctaaaaacagttgaaagttttggaacctgaaataggtaaacgcagcccagttctctcatttccttccctggcagggaaaggaagggtgttggcagaggctctttatttcttgcaaacagctgcctagacaacaccccagcctcctggccaggccctggctatacattcagtgctgctcaggggctttcagaggctagggttctgacaatgccagcctcaccaggtgctggaaaatttgtgacttctttggtgaccttgggcaggtgcctccctacctggtcctcactttccccatctctctggagccaggagccttaaggcccccagcccactcacacttgctccaacagcctctcggcccaagggccttcaacatcttgtctcctgttcttataagaaccctaataggtaggcattaccctgcccctccccacaatctgaaagatcgggaaagggaagctcagaggcgtcagatcacagacaggattacttacccaagagctaagtttctctgctgggattggactgcaggactctgccctctactcttgacacaggcctgtctcattccactctgctgcttccctagggaagagagtggcaggtaagacctgttgaggcagaactattgcacaaatgcacacatgatttttaagcaaagataaagaatttcctttcttcaccccaaagcccttcatccaataagttcaggctcttcatagtctcagctgatggacactcactcgatttaaactggtcccagacccctctcttcccatttgctttgaatgtgacaaggcgcttctgcagcctgcatctctggacaaggcttttttttttttttttttttaatttgcctgttggtgaaaggctcaggcctgtaaccagtacttccctcccctaagtaaatacaaagaagaggcttgcacaccctgccccgcacctctctactctgactagttgctcaggtcctcaaatgtgctttatgatcctgcatccaccattatcaccaaggcaggaaacccagagcagtcctgttatttcttcaagagatgcttcctgggcttctacggtccctgggccattgggccattgtgctttctatctgaggaatacacatcattgctggagccttagttccatcctggacctaggagagctccaagctggatctgggtcagttctcgtgtgtgtgtgtgtgtgtgtgtgtgtgtgtgtgtgtgtgtagttagagtgggggatgaggatagctgctgtgctttggtgagtggtgaattacctgggtacagctatagcttttctcaggatcaattcattttgagataaatgggggtacaggggaagagataccacactcaaaagccagttttagtctagcctcaccattgcatgatcttcaccaacagccatgttactgctctcagtttgtctgcctgtaaaagtggtgatagataatatcctaaccacctcatggttaggtgggtctgacaagctaatgggtggaaacccactttgcagctcatagaccttatcccagtgtgcagcctttccccagtgccctgaacagtggctcacacttctcacccttggactcaagggcaagtaaatgcccccccacccccttagttacccccagatgccaagcataggtctccatgccctttcactactgtacctcattacttcaactgactgccttggagtcctgtatcttttactttgggttcttgatctttctcgaactcttcccaaactctaaaactaaccagttggcatttactcactcactctggcattgaacataaacttccgcaccattgtcagttctctggggtcctaatgtgcttgtctgcaagccttactcatgtctacttctacatgtaaacatttcttagcctatccttccccttccctccttgctctttttccctttatttattttccttttctttggtaattgttgctgtttctatgcaatgatttcttttcatcttttttattctctctcatatctctttctaaaatattataacaatcacgtttcttctcattattttcttgtttgttaggagaaaagaggcaaaatatttatcttgtacatttgatcgctgggtgctttttataccatttctctgaactttgatttttcgtaagtcgtacacagaagactatatttccatacaatttcaaaggtgtatttctaattgccttgtgcctttccatggtaactaaaaccacaagctggaaactgggaatttatgaatggcactggctcaggttacaacaaatcaagcttctaagatcagtttgaaaaatgtcctgttttggtgtgtagctgcaaaatgtatgtcaccgttttctaatttttaaaagtttcaataacatttattttttacattgtaaaagtaacttatgctcattatacaacatttgaaaaacacagaaacatagaaccaaaaaaacggtagtttcatctgtcaaaagcaaccacagttgttaacactttgttctatttcctaaatagaacaaaggtgtcattgtgtcattatttttaaatattttttgtgcctttttttttttttttttttttttttttggtgacaaaatcttgctctgctgcccaggctgcagtgcaatggcacgatctcagctcactgcaacctctgcctcctgggttcaagggattctcctctctcagcctcccgagtagctgggattacaggcaccatgcccaactaatttttgtattttttttttttttagtagagatggggtttcaccatgttggtcaggctggtcttgaactcctgacgtcaggtgatccatctgccttggcctccctaactgctggaattataggtgtgagccaccgagatggaacgtgagtcactatttttaaaaatccataacaaatccacaaagctgtaagctctgtgaggtagaaaccatgtcttatgcatctagaatactgcatggtataaaagggaactccataaatgtctatcagagaataaagcttggtttatatatttgggtttgcaattcatgatggtatttttaccatagtattaaaatactattgatactttatgcatgttcatgtcaagtttgtatagtgcaccatgtggagatggtctcagagagggggctatcctaccttctgagcagggctgggaaagcaccagggcagttgttatcaccactgtgtctgcagcctcttctttgtactctcatcgcatcctgtgcttctctgtttagaactctcatcatgtttcacagttgctttttcactgtctgccttttcaaattgtgagccccatgagagcaggtatttttgtctgtcctggtcactgctgtatccccaacacctagtttagtgcctggcatatagtaggcacttgataaatatttgttgattgatggaatgaagacaataacaattcctgaaattaaagatcttgctgtctagcagggaggataaaatcagtttcctgataactaacacaaggaagactcctatctcttctctcactgctcttttaggatgtctcatgaagttggctgtgtaggctccttttgttttccctgtattgtggctgggggaggtcaaagtgcagagatgtaacaagactgatggatggcagagaagggactacagtttggtttctctgactcctgattcaatgctctttctacaacatctcattgatgaccttctacttcagaaaggtttttttttttttttttttctatgactctctgaaacaatgttgtttggttagagactagaattgggaagatctttgatgtcaaatatttgtctgtgatttgttacttcggtaaaaatggtgtgtggtcacctcaaggaggataaactcaggatctcttaatagattaggcagtttgaaactcccgtcttcacaggttccagtccactctgagggaggcctccagtgaacttggaaatagctttcttcttcccagaaataacctcagatatctgttaaggggataggtggatggattaatggatgaaagaaaatgtccctcaggaaggggaatataatgttattcagaacacctagatgctttttcatcagttcacttatgtgatagttcaagtctttcacatgtagctgcccccgaagattctgttttacagaaaagattaaaataaaataggacttaagcatcttttctttttctaatactgtaatgccttcttatagtggacatgttctccactgttgaatgcgtgtttaatcagaatgtaaattttaaatggcctctcctttcctccagttaccatgtcatcattttttagcaagtctcactttgttttagatttaagcttccctttttcttacattggctgttattttcctattaatgatacttttctactttatttttttaacttttattttaagatctgaagtacatgtgcaggatgtgcagccaggtatggttgagttgttttgtgattgctttaataaatgtacctaaaagtattgcacaagaaaaagagaaaatgttcttcagtgcaggagcaagaaggtgttgttgagacatttatatcattctaatctgcttgcagacacaagcttgctctctccaaatctctgccatgggcatgataaaacttgttttaaagaggttgtagtatgatgataatccaagcttactgggccagtgccaatggaagaagacaggcaagtggtacaatagaattaacaaggcaggagggttcattgtgtgctcaggtaaggttaagtagacagtttgggacagcttagtggtgcagaagaaacattgatcattcaagtcttccagccaacatttttgagaatctactatacaccaagtcctatgtaaaagtctaagaatacagagatgactaagtaagccacaacccttgccctcaagttgttcccagtctaacagctctacctaaaagagtcaagaccatcttcctagaggaggggatacttgagctgagtcttgaaggttggagaagaatttgcctggaggctaagttgagaaggaagaaagaaaagcatttatgaaagagggaaaggcaaagcttgttcagaaacatggagatatgaaatggtgtggtgcttttagggactgcaagtagtctactgtgcacatggaatcaagaacatgaaaaggaatgtgatgtacactgaattaggatactggcattatatataaaaggagatggataatcatgagaaatattaggattaagaatacacaggacttggtggccaatgggatgaataaagcagtagaaatcaaggatcaatcctgggtctctgacttaggcaaatgaggtggaatgtcattaaccatgatagcaaatataagagaagtagatatgagctgagatgaggctagaaagttagacaaaggcctatttggggaaggctgtgttaacactagcaaggctagaacaggaaaggtcttgaaagtcaggttatagggaaatctaaagaattttaatcaggagagtgatattatcatattacaatttggaatgttcactctgactgctgtgtcaaagtggaatccacaaagcaggtaatgatgtgaagggaatggaagagtcaaggatggctcccaagtttctggcttgagcacctgagtagatggaggaatcatgcactgatattgagaagacaagaaaaaggcagattgaaaagtgaaaatgttgagctaccttttggatatgttgagtttaggaagccatggtgcgtctaagtagaaattccaggtggtgattggctttatgggtctggatctcaggatagaggagtttcgcatagattcactgcatagatggagtggcagatgccatgggaaatcacccatgatcagagaaaagagagtcaagaactaagaaacaaatatttaggaagaaatgtatgaacttataaaagactgacaaaaagttggaggaaaacagaaacatgatttcatggagacaaatgaagaaatagttgtttcaagagtaaggaagtaatcaagaatataaaatgctacaaaaattaaggcctgaaatgtgtccatttgactttttttttttttagttgggagctataaatgagaataattttagcagaatagtgaggtaagatcctgattacaatgggttagaaagcaaattaagaacacacaattagaatatataattttaaaatatactatttacaatggcaactgaaaatataagattcttagacagatatctatgaaagtgcatgcaaaatctttataaataaagttctaaaatgtagtttaaaaatcataaaacgagacttaagtaatggtaagatataaatataatttttaaacataatatttacaatagcaaccaaaattataagattcttagacaaaaatctatgacagtgcatgcaaaatctttataaataaagttctaaaacattgtttaaaaatcataaaaggagacctaaataatggtaagatatactatgcttatggatgcaaaaaactaaatatcataaagatgtcaattctccagattattctacatgtgcgacgtactttcagtcaaaatcttaactttttgtggtacttgatgagctgatttaaaaaatttatacagaaaatcaaagggccaaaaataaccagcaaaatcttaacaagtaaaacaaggtaaggggttttctctactacatatcaagtcttattctaaaacaatgaacattatgacaatgtggtattgcatagggataggcaaacagatcaatgaaacagtacaatgaactcagacacataccacacatttatggaaattatatataaaagagatgtatgaaaaacagtgaggaagccgggcgcggtgtctcccacctgtaatcccagcactttgggaagccaaggcaggtggatcacctgaggtcgggagttcaagaccagcctgaccaacacggagaaactccatctctaccaaaaatacaaaattagccgggtgtggtggttcatacctgtaatcccagctactcgggaggctgaggcaggagaattgcttgaaccttggaggcagaggttggggtgggcggagatcatgccattgcactctagcctgggcaacaagagtagaactccacctcaaaaaaagaaacaaaaacagtgaggaaaagaaaaactgttcaataaatggcaagggaaaattaggtattcacataatgacaaataaaaatataaataataggtatttattcttaccttaaaccatatgcaagaagtaatcccaagtgggctacagtgctaaagtgaaaatcaaattttaaacttttacaagaaagtatagggaaatgtcattatggccttagattaaggaagggattcttaaccaagtcacaaaaaacacaaaccattaaaaagactgataaattttgcctttctaaaatgtaaaatatctactcaataaaagacaccataaaaagagtgaaaagaaaagccacaaacaagaagatacatataatgcatataacttataaaatattaatatccagaattaacaaagaattcataatatcaacaagaaaaagacaaaacaatgcaaaaaatgggcaattaatgttaacaggcaatagtagaaatctaatagccataagcgtataaaaatatgttcaacgtcactagcaatgagagaaacacaaagtaaaactacaataaaataccatttcacattcatataatagacacatatttaaaagactgataatactaaatatcttaagggtgtgtaggaaccagaactctaatagcaagtaagagtacaaaatgatacaacctagaaaagcagtatggcaatatctggtaaaactgaaaatgaacacctagcagttccagacctaagaaggaaatatcctagaaaaacgatctctcactgtgcagaaggagacttgtacataaatattcatggcaatattttctgcaatagtaaaaaaaattgaaaaaagaaacaggagaatagataaattgaagtatattcataaaataatactatagcagcagtaaaagtaaatgagttatagtgtatatgtatcaacacgaaaaattacaagaacacagtattgagtgaagaaagcacattgtgggaggctgaagtgtgctgtcatttatgtaaagtttaaatgcatacaaaacaattatatgtatatgtatatatatacacatatatagttacatatgtatatatagttatatatgtatatatttatatatattatatatatattatatatatagtttcagaatgtgtaaacctgtaataaaattagagaaacatacatgggaatgataaaaaagacaagtttaagatagcggttagctctaggaagacaggaattgaagtaaggagggaattgcatcaattggaactttagtattttgtcttaaaaatgagatctgggccgggcacggtggctcatgcctataatcccagcactttaggaggccaaggcaggcagatcacctgaggtcaggagttcgagaccagcctgaccaacacagagaaaccccatctctactaaaaatacaaaattagtcgggcgtggtggcacatgcctgtaatcccagctactcaggaggctcaggcaggagaattgcttgaacccgggaggcagaggttgcagtgagccgagatcgcaccactgcactccagcctgggcaacaagagtgaaactccatctcaaaaaaaaaaaaaaaaaaaaaagagagagagagagaactgaagcaaatgtgcaaattcttaggacctgaaaaagctaagtggtgaccacatggatgttttctatgttgttctccatacttttgtatatatctgagatatttcataatttataaaagagagttcaggaagttgagcagtgggagacaatttaggaatatagttgagaatggaaaatagaagaatctagacctaattccataggaaatggggagtcatggaaggtttctgagcaaaagtgctgggatcagagttctgctttaggaagagtcccataaggagagtagtgaggggacgactgcaatggtttagatatgagatgataaaggcctgaccatgggaagaggcacagagattggagaagaaaagatgatgaatttgggagacacaccgagacagatagaagaaataagaattggctttcaaatcagacctagcagagcctgccaaaactttttatatcttgaaaaacttagcagagagtgagagagcaaacaccatcataaattacagagccaagccctgggtctctggtagttccagtaataaaaagaaatatttattgaacagctcagttttagtctggcaatttattatacagaagcaggaagaagaaaaacacaggctttcttttctatacaggtaagaggacgtgcaagcagcccatctgagaacacatgagagcaccatcttcttttggggaaggacccaggctgagcacacctagaaatcacttccacgtggaaaggagcacctgaaataaaattattggccaaaataactggtcattcttgttgctactcagcaacccagagcatagcattggttgtatttagtcttttcagacacagaaatcactttgtatttcagtattttataactatttagtttgtgtactaatccaggatgtccaaactggtgtcagcctagaaaacagtgcagctgctttctagggccagtgctgcatggcatgatttgtaaggacagagttctgtgatgggctaagattttgtgaatagttttgtagccaagcactagactagattatttgaaatgccttgtcttgattttccaagttttgcttattctgaatttttcacacacacccatctcccccattgtcctggcggagatgccaaggtctagagatatactatggtcttctctgagtcacagcgtgagtaaatggctataccaggactagaaactgggtatcctaactccctatataatggtcatttcactaagcacattgtctccctctcatatccttcattgtgattcttcaagggaagataacaaagtattcaaatgtagggtatgacttctctaatgagtcaccaaattgaccatttttaaagttataaataaaattaaaacattcccttcaactaaaagactcgactgaggaagttaaaggaaattatgtcagggaaatggggtggtagggtagtggggtggtggggctcataaccatgggatatgtaaccagggaagccttgagaaagtccattaagagccagtggcagagcaatcttacaggtagttctcctggcagtggagacagacagctaggggacaccaaggaggcctagaaatagcattgtctcccttgctcagagccttcaaagaatctctgaaagtggttcgactacaattaaaattccaggtgcctttttctatttccttctttattctttccttcttctatcttctcagtgatgtttcaataggcacttacgggaactaatttttatataacttaaaatgtgctgtccttggaagatctacatctgatcacaccattcatagcacttattaacaaattgcggtgattttacgtatttgacaggttacttgctgttgtgcatccccccattgccatcctcaccccactttcatagctgcctgcattatatatacccttggctgtaaaccttataaaggaagatactgtgatctgtattatatgttactgtatgtagcctcagaaacctgaacagtgtctggaacatagtaagtactcatcatatgatgtaaataaatgatataaataaatctccaaattatatttttaatgctttatctttaagtagagaatgcctggtgtcaaatgaaaaccaagaggaagcacagaaggctctctgaaatttaatttttaagtctgagtaactctgttgaaatctaatgagttctgctataatttaaggacaatacagaggaattttatataaaaccttggctttcattttatgttagcaacaaccatctcacagaagagccaagaggtccggcaagttgactggtgaaaacgctgtgacaaagtgccacaggagcgtgctgggatctgcagaagaaatggaaaggaactcaacaatgaaaacctcttggcaacatgctaggagataaggggataaacacgcattgtttcaaggagtgatggtgacataaacttgagactctgaagcccaaaattgggatccctgggtctctgagcagcaggttggaggatcagtttctcttcagagtgctttagtcctagatgataggtactcactgtggatattctgctgcctcaaaaccagttctgccagacttccagctaccccaattagagccaaaaaaaggtggagagcaaagatgatagtttaaaaacttgattaacaaacaacaaagcaatagaacacgcgagcacgtgcacacacacacacatcccccaaactgccctggacatccatgaaggtaagagagaattgagaggcagttacttagttagctagtgttatggtggttaagctcatcagccaactcgtttaatcatgcatgcattcattcattccaaagtatatacagttttgagcactggagatacagagatagattcattaattggccctctctgtagagggggagagctataagcaaacaagtaaaataatatgatgagacagagatttttagaaatagttgggagaaaaagatatagaaatggagagaacaattatttatataaagaagatgatatttgatgtagaccttgaatggtgaacaggaggtaggaggtaggagggtgtaaatgggattgtaatcagaggcaccagcacgagcaaagatattaaaacatgaaagtgcctggggacaatgccattcaggcaaaaattcctgttgtagaccattaaagacttgagagagcttgcttgattacataaatatgtctccttacacaactaaaagctccttgagggcagggaccttgtctaattctgtctgaatttcaagtgcccagctcagtgcaaagcactgagtaggtccttactaaatatttgttgcatggatgaatgaatgacctttgccagaacgatctgagagtggaaggggcaaaagccagatttcattaataaagacatgataggtgaagggatgaggtgatgaagtgaagacatgaggtgatgaagtgaagctcattcatgttgcctcagcttgacctttgtattgcctgtggtttccatagaaaacctcacgtaggactgattattttccatttgaaattgcatttcaaatatattgtattgcctgtggtttctatatattctatatatgtattgcctgtggtttctatagaaaaccttacataagactgattattttccatttgagttcaggcagcattgcagttaagctttgcttcccctcctttgctccccttcctttggcttcctcctcctcttctctgcaatgcttggccctattggccacttaagccactaatgcactcatatacttctgaagttcagtattagagatcattttcctcagcagcccgattcttttgtcttttatcattttaagtcctttcaataagctctttctttgcacctggacttacatactctttattgtataagcgtcatccgttggattcaaagtctctaagagagcaagggttggggcatctttctggtgcccttctttttggggaaatcctatttcctcttttggtcaacttaagatagtaactgagtaattgggtctgtgaggcatttcccagaatatttccactatgttcctagctaattctatggaattaccttcaagttcatcaattcccaactctttttttaaaaccaggatttcctttgccatttcatttcctaatctttcatggttttgcttttctatgtcttcttccttcttctccacttggtcacctacttactgagagttgatgtcagtccttaactggtcaagctctactcaatctcaagaactgaagatctttcactcttaggattaaccctactcagtccctgaacaacagagcctggcatggggatgggagctctcaccatcttaccccatcctcagcaagtggactctcgagctagtcttgttgctccatccagtgagccactcaggcatccaaatgcctgggtgaagaaccccattaaccccacacttagcagcacaaatgctatccaaggtcctgcttccatagcaaaagtcataatctcatgtaacactgattccacatcatcacttttacctaccttttagaagtgacccttttagagtgttcaaaatcctaagccagtgaagatcatgctcacaagaatgtgaaagttatgaaatagaggaaacaaaccaactcttcctctaagtctgaatttcggctcttgagaagatatgaaatataggataattttcctaacgagattatttttgatacttaattttatgaagaatgataaaatgatggaatgttaaagcttattctgctacacccattggcttaatcaaatccacctagattggcctgtgagccttcagggccacaggttgccataatcatcatcctcaagttcccagaaaatgtctgcatttgacaggagactgatattgcccaggatttggtgtgggtgtggatgtttgagctgcgctggttgaactcctgccaaagtttgtatatatattcccagaaaaggctattccagacccagagctggttttgatcactaacagatctgaatttttcatggcaaacagggtgtatgtgtacgtgggtgtggtggtggtggggaggaggtgctggtaatggtggttgtgatattttcatatgattttaactgattaatggctataatctaagagtcattttggttttagcactttttctgctttaaacagaaacataaattaatctttcttttttcctttctcttccactgggtattgtcgcacttagcatctggatttaaataaataaaacaaggtataataaaaagagacttagactgggagttgggagtcccagatcctcatttcacttctctactgattttctgtgtgaccttcggcaagtcaattcacctctcgagacctcagttcctatgtatgtaaaataagggtgtcagactaagtgatctctaacaccttttccagattaaaaaatcgtttgagtcagtggaatatataacccagttcctttctcaaaggtagcattttttcagttcggggtgatctgcttttggggatatgggacagtaattaaatctatgaatctaagatgtcttcagaaacattgtattgatgtaacccaatcctgtaaaaatagtttctgcctctatgagcctaactgaggatctctatattcagttttattccattatttttctttgttttcatcactttttcactggtctgagagaatgagatccacagccaccttctctgaaaggccacccattgactaagcactttctcccctaaattcacctggggtcttcatcagtgctctgtgcccttccctcaatgatgatggtcctgagaacagctgtggcaatagacatggctttttcttttttgttgttgttgttttgtttttgttttgagatggagtcttgctctgccacccaggctggagtgcagtggcatcatctcggctcctcccgggttcaagcgattctcttgcctcagcctccggagtagctgagattacaggcgcccgccaccatgcccagctaagacatggctttttcaagcacacaccacagagagacatgttgctcagcttggtctacatggaagaccttaaacaacaggctacagcaagggatgtggattcataggagctgcctgcaacttctgtgggagttgtaggactgatctagttattccagcctcagtttaatttgaaaaaatagagatgataatacctcatggattttatttcatagagataacatgtgttttataatcataacataatttctacgcacccacaggcaaatgttagttataatcagagaacttcctccttgagaagggccttcgagattatctagtgaggcttcaggtaacagatggggaaactgaggcccagaaagggtaagggccacgtgtaggatactcatcgcagagagaaggaaaaatggtctgggctgaatatggctttgcctttggcttctccagatgcaatctctggcagagcagaggggtgtaggtaaatgttgacagctctgaatgtttaggtggaattatcactgaaaatctcccctcacaggacagagagggagaactagtcagaattacagataaacaaaaacttggcaaacagttctatttcataaataaaaatactggaggaaaactacagcactaagagaatcccttcctcctcattgctgaggttgctctgtgatatattatgccttcaaatctggaggacaaatctgacattccaaaatcagcctcactcattcagcatttaccaaatgctttactgtgtgctcactgtgttgggtattgtgctaggtgctaaggagggcacagaggtacaaacaaatacttacactgcaagtgggcaagtggcaaaaactgtgagtgcacaaaagtgcccaatggaatacaaaggagacaaggaccaactatggtgccattagccaagaaaagctttacagaagaggtgatatttaagttgggtctcagctgggcactcactcaattgggaaagcagggaataatgtgtgtcacaagtactagctcacttatttctgtgcagtaagtgcttttgctatttccaattaagagatgagaaaattggggttcagagagattaacttgactgaggccacacagctagttcaggtagaaggcagagccaggatttgaacctagatctatctgattccaaaacctgttaccttaactaccactatgctatactgggaatttagtcaaagaggatagattgtctagaagcacagaggcctggaagagccaagatggtttgctccagaaataaggaggcctccagtggtggaagacaaggctaaacttgattctattgtcagtggggagcaatgcctgtttctcaaggggaggggagtgacaggatcagattgtgattttgctttgtttagttaagtttagcagcatcattctgggtgcagtgtggagaatggattgtaagtgggtgaagggaaagtggaggtccaggcaagagacagagtgccttggactaaaaatagtatagtaggaaaggagaaaaattcacagattagagagggtactcagaagatagaatcaacaggagttaatgatagattgtatgtgggtttggaagacacaaaggagtctaggatgactttcaggtttctggcttgggtgattagcagatgaagatgccatttagcatcagaaatacaaaagtttacaggaaagacatgctgaatttgaaggccattcagataaagacgaccagtaggtagttgggtctataccatcgtatgtgtagttagtaactgaagccacaaaaatgactgagcttatcctggagaatatgtggtctggggaaaaaggacagtctagggcagaagaaccctgagactcactgacatttgagagttgagccgaggaaaagaagcctataaagcagaaatttactctcaatccttccatcgtgacctccacacactatggcaggagcacagtgtgtgcattttgaggtcagcagtagggaagcactgagtgtgacagaaaaccacagaccaggaacagtacataagataggcccaggaactgtgggaccagtaaaggcccccatcccacatacctgctcccaaacggtagagatatcgtaacaaagcatattttacattcatttaatgtttccattggtgagccatcagagaatgtttgattaaaactttgattaagcatttgattaaaaagtttcattccttctgttacctcaaatatttttgttggctgtcaccaatattatatctgtattattttgagattctatcttagcaaactggaaaacaaaaagtgatttcatctaatggatctgaggattcatttgccttcatcaattttctacattttaaaagtcaatataagtttctctttaaaaaattaccagttaaatttggaagcacattgactgttcactatgtgtcactttccctctgttctaagaagaaaaatctcttcagaaaaaaaattaatacaatatagaggttaaacaagtcaaaagaatcgaggtgggagttgcactcacatattgctgaagggagtggctttggggtttatttgtcatttaactaggtctgttcctatgcaagacaaatcaatgtggagccacacttagtcatcattgatcaagttccatgatcaattcagatttgttctcttgagagtttttaaataagtttagctaaaagggaacttgctgcctgtctgcattagcttttgcagaaaaatatttgtgtatttctctatgacatggagttgatatatgacaataaccagagacttgcttattttgaaatcagaaaccctagaggctggcttttaatttcaacacctttgttatggaaaattcatttaaaaggaaacttccttggccatgtcaaacttttcatcacctctgggagaagacttttttccctcactgagcacattgtggggagcagggggcaatacatcacaaacctgaggcttgtggggagtggggccaatacatcacagacctagggctatgcgcttgtcaccaattccacctttccagatcttaaatgatgtcagctgctaggcctatcagccagatgtttggtcaatgtgatcaaggtaggggatggttcttgttgccaagaaggctctctatatgtgaacttcagaccatctccctccctcagtctaacaagtatacacacacacacacacacaagttgcaagaaaacaaatgaagatgatagatgagtcaggccaaatccagtccttaacttaaaagtgattatcatctcagcatcttcccactccatctttgcccctgttccctagctgaagtgtcatttaactggggggaaattcttgtgcaaataacttgatgctttctcggagcacacaggtttggcagaataaaaaagtaagaggagtatccagtgggtggatggaggactggattgacctgcctactttgtagctccaacttcaaggtgaatgttttcaattcaattgctttccttctaacacttagttgccttataaactgacccttcacccccaacaaccattttgttttctttgttactgaagtgggttagggaacacacctaaaaaaatgctggagtgaaagcattagtatagcctgaggagactgaagatcaggaaatagggaggagggaaaagacccagtcaattgtaacactgaaagaaaaaacacaaaattcatctccaaaatccccctgtagcaccaagcacagtgccaggcacagtggtttgtttaggaaatggtagttgaattgaagtgactttttccattaccaactttgggtaaatctctcctttgcctaccactccataaaaggaaatttctgcttgaagactctagaactccctttggtgccctcagacctggtattttcctccattgtgccttacctacctttggaggactagtgcagtcatacataactgagtgcaatgtttctatggaaaaatgtcctcagagttccaaaagtaggatgtacaaataagcttttggtgcacagcctgttcatcagtaaactggggatgacttatgttcttccaacactttaattaggagaaacagtggtccgattttcattgtctgcctcattaagctgcagacaattaaaagcaaggcacttattacctcagaatgtgataagagcaaaactataaatgggttttgactactgcattcatgacaaagaaataatggataatgcttcctgagtctcaggcactgttctggatgctttacctagattaacttatgtgatcttcgtaacaaccccataagggagctactattagtatcctaattttaaagattaggtacagtggcacatagaggctaagcaacttgcttaaaaacatagctaccaggtggccaagctggaattcaaatccaggcagcctggttccaacttggcattactgtgcctccattgtctacctctaagtctttgctcatagtactccctattcctctagtgctttccctttgttgtcaaaattcctttcatctcttgaggtccaatgctgcctccttcacgatgccttcacagatcctccttgttggaatcagcctccattttctgtgctcctagagttttgcaaacttcctattatggcacttttcatattttgtctttgatttgtgctatttacaaacattttatagagtgtgctgctcacctccccacattggcctagtgattttagggtagaggctgtactttcctcaccgtcatagctcctttaagtgcccagtggagtatcttacacaaaataggtgaataagatgtggtccctcccctcaataaatttacagtcaccatcttaaatacattattcacatccaaggagaaactcaggccctatctacatggaacatatttgccatttgtagaaccagttccatattctggaaccctcataatggtcttgtcctgggcagtccccagtatagaggataagctggtgtagtgctgtaatcatagaagccttaggctctttaagggtaaggaactcagatcagcctcctaccagacctaggaatctcctccacagagtccttgccaaagggcctcactgtctacaagcagtgtcctggacatggcaggtgcctcttctctcatggagtcagtctgtgcccatgtatgcagccctgttgattggaaggtctttctggggttgggttagaaatctgccttcctcatgtctgtgagcccttgttctgcccaccacctgctgcacccaaaggtcacaccactgcaagtctatcttcttctttcagttattttggaagtttggttctgatcaactcttcagttatccacttgagaatatgatgcaaatgattgaaataactgtacttcgtcatcacacccaccaaattggattaccctttcagctatttgatggattacttagcaaatagccccaagggggctgaaatgattgattcctatttgccatgtatagatattgtcaaggggagagtgcctctttgttaaatgcttaaatggaagaataacatctatccactcatggtgagggactgtagccaccaatctcttgtgctccatagatcttggtgtgagcgttctccccttcatattacacaagatgttctgggaacaagtacttttttcctctctatctttctatggagttttccatgactcttcctggcctgaacttcaggtatatgagacaggagctataaaaaaaaatgttcaattttaaactttgaacaaaagttgtaggaacaggacatctggacagtttataaatggactcaacattagagttatcttaacaaaggttctaattccattgattccattttatttgctgctctattttgggtccaatgccaaggatgaagtcaatgaaatcaggaaaaatagatctactgcaagagttgctgtcaaggagagattggaatcagggccactttcaagttcaatttttgccactaactgactcttttgctttgggcaagtcacttaacctctctgagcctcagttacattatatgaaaaatcaggacagtcatttctgctctaccacagggctggtctgaggatgctgtaagacaaactctgtgaagattctggtttgttttccttgagaaatgtatgaaataacacagtggctactttctggggctgccaatgatagtaagtgatatggtttggctctgtactcccacccaaatctcatgttgaattgtaattcccagtgttgggggagggacctagtgggaggtggttggatcacgggggcagatttctcccatgctgttctcaagatagtgaatgagttctcatgagatcttatggtttaaatgtgtgtggcacttacccctcactctccctctttctcctgccaccatgagaaggtgcttgcttccccttcacccttctgccatgattgtaagtttcctgaggcctcccagtcatgcttcttgttaagcctgcaaaacgttgagtcaattaaaccccttttccttataaattacccagtctcagttagttctttatggcagtgtgacagtggataatacagaaaattggtactgggagaggggcaatgctataaagatacctgaaaatgtggaagtaactttggaactgggtaatgggcagaggttggaacagtttggagggctcagaagaagacaggaagatatgggaaggtttgacacttcctagagacttgttgaatggttgtaaccaaaatgctgatagtgatatggacaatgaagtccaggctgaggtggtctcagctggagatgcagaacttgttgggaactggagtaaaggtcactcttggtatgctttagcaaagagactggcaagattttgactctgccctagagatctttagaactttgaacttgagagagatgatttagggtatctggtagaagaaatttctaagcagcaaagcattaaagatgtgacctagctgtttctaaaagtgtttgctcatatgcatgaacaaaaattatctgaaactggaaattatatttaaaagggaagcagagcataaaagttagaaaaatttacagcctgaccatggtagaaaagaaaaaccaattttctggggataaattcaagctgactgcagaaacctgcataagtaaaaaggaacctaatgttaatagccaagacaatgtggaaaatgtctgcagggcatgtcagagacctttgcagcagcccctcccatcacaggcttggaggcctaggagggaaaaatggttttgtgggccaggcccaaggccccactgctctggcagcctccagacatggagccttgtgtcccaccaactccagctccaaccatggctaaaaggggacaaggtacagcttgggttgttgcttcagaaggctcaagccccaagccttggcagctttcacatggtgttgggcctacagatgtgcagaaggcaagagttaaggcttggaagcctccacctagatttcagaggatggatggaaatgtatggatgtccaagcagaagtctgcagcaggggtggagccctcgtggataacctctactagggcagtgcagaggggaaatgtagggttggaactcccacacagagaccttactgggacactgcctagtggagctgtgggaagaggaccaccatcctccagatcccagaatggtagatccactgtcacctttcactgtgagcctagaaaagcctcaggcactcaatgccagcccatgaaagcagccatgggagctgtaccccgcagagccacaggggcagagctgcacaagaccttgggagcctacctcttgcatcaacataccctggatgtgagacatggagtcaagggagattattttggacctttaagacttaatgactgccctactgggttttggacttgcatgggaaagggcctgtagcccctttctgttggctgttttctcccttttggaataggagcatttagccaatgcttgtactcccattgtatctcagaagtaactaattttttttttattttattttacaggttcatatgcagaagggacttgccttttctcagatgagatgttggactcggacttttgagttaatgctgaaatgagctaagactttggggaactgttgggaagacatgatcggttttgaaatgcgagaaggacatgagatgtgggaggggccaagggtggaattataaggtttagctctgtgtccccacccaaatttcatctcgaattgtaattcctaatgttggggaagggacctggtgggaagtgattggatcatgggggtggacttccctcatgctgttctcctgataatgagtgagttctcatgagatctgcttgtttaaaggtgtatggcacttccccccttgctcacgctttctctcttctgctgccatgagaagaaagtgcttgctttccctttgcttttctcccatgattcagtttctgaggcctcccagtcatgcttcctgttaagtctgtggaacttggagtcaattaaacctcttttcttcataaattactcagtctcaggtggttctttatagcagtgtgagaacagactaatgtactaagcaataagaaagatgtccaggccccaaatgccccaacctgacacctagctggctcttaaagagggtagctactgtgaagagggagaaaaaggccttggcatctgcagaccctctttctttatgatcctttaaatataaaggatgtgtttatgtctgtcttcctaagtaggaagttttattctttaaactaaatttgacctactggcatgtgacaagaatcactgacttgtcattactggcatgtgacaagaatcactgacttgtcatctaactgacatctgaagttcctaacatcctaagggatggggacaagtaggaggaagctacagaaaaacatatatgtctgagtttttgttttaaatgtgtgaggtaaaagcaaattgtttctgttctgcttaaactgttatttgaaagtatgttgccccaggcctaggcatttgctaagctctctcaaattcacatcttctcttattctctcattctctgcctccagtggtttctatttagaggtggatcaacccattagcagtcttggactctgctccttttctgcttctcagaaacccctttcagttttctaccatttgcagcacacttcatgcaataattggcaaaactctgtcaatttaattagacttcctgacaattccagaacatctccccccttcaaagcacttgctttccaatagcaactgaaacataaatcctgatgctttgactttcatgtttctcttgaaataatattgttaatgactttttgtaaccattggaggcctttgaatagagtttgaattaaaatactggcaacaaatatctgtgagtcatgtaaaaaaagctcaaaattaaatgttcattttgcacagaagaacattttcattaatatttctttgcttgatgtatctgatcttgtcataaagagttgtgctaaggggaaattttgtttatagaattatatcatattatattatgtttatatcatatttccccattgtttaacactgcaaaaatataaataagtgctcctgttaggaagaaaacaatttgttctcaaaaacgtattttataatgtatcaagatttttaaaagatcatgtattgaatagattcactcattttgtaaataataatttctaaaaataacactggaaaaatgtgctaagaaatgtgacctatttttgtgaatcactgatgggtacttaggatggatttctttctttccccctcaaataggctcccaaatgagctatttagagtgccttcgtgcttgcctgggaaatctcccagggcttctggagtattaagcaaggatactttttcacaaagatttagatagaacccaaaatttagccagaatgtgtttagaatggatacactccgggtgccaaattgattccttaaattagaattttcagtaatttgcaatattaactgaacgcttaggtacacttcaaagcataaacacctggatcatgcaaggtggagggaaagaaaggatggacaggacaggcctggggtagcaaaggtattagcaacagtctcatagtcctattgccttaacacaagaaagagataagagccctcaaaggatggatcagtgatcctgggacactcatcaactacacctccatcctctccctggtgaaaagtgactcccttagctcaatatcacagggaatatctttgatccatcatcatgcaatgttggcactggaagggctttcaaagtgagacaatacatcatgagtacctaccatgtgccaagacctgtgctagatgctagaaaagtacaagaccaatgaagcataggccctgccttgttaaatttagtccagatctgcctcctgatatatgttaagttcaaccgaaatgttgctccatacatagtgagctgtaacttaactggatgtatactaacctactcttgtgccaatcaccaagtttcagccaatcacaggtggccaacttttcaaactgtgttcaaaaaatgcagacgctaagctgtaaccaatctggctgtttctcatttccatttttgcacatggctttcctttttctgttcataaatcttcttatacactaaggcagtgctggagtctctctgaacctattctggttctggggctccctaattcatgaattattctttgcccaattagactctgttaaatttaatttgtctaaagttttcttttaacagcctcaggaagctctctgtctggtccaacttcctaattccacacatggaatactggtccacaaagcagaaggggtttgccgaaggtcgtctggctactcaggagcaggcctgcagatgaaccaggagtcagatgttctttcttcctcatcatgttgctgcctttatcacacggtgttataggatttgtttgctctgagatttgtgtttgttgccggatcagaatagcttgcaaactcaaaaagaaaaaaaaaggttttgaatgactctttagccttgacctcaggtcgggctgcaacaacaatgaggaaagtaaagaccttctgtctatatctcccatcactcttttgggaactctgagataggaagcagtcaaagagcaatggaagaaatggaaaggcacatgactctttcatgctaccatgcttctctcctttttcttttctaatcaacctttggagatggaaatgagttagaggagaagcccatgaatttttcatgaaggagcattgaatatgcccagatggcctccccagtgggatctctgaagagcagtgagggaattctctcacccagccttctccttagagggacccacagtggtaagaggtatggaagaaggcacaaggaaatgctggggagatgctggatagaacatgtgaacaacactgaagaggtgatgatcacaaagtatcagcaaattcatcatcagacagtaaaagacaaggaaagaatggaaagaggtaaataaatcttttgccctagggcagagagaatgacagacatgaatcctctccactttaaagtttgataaaatgggatgagatgcttttagaaggtattgtaaaagtgagacctgttggaagatccaagggctccattctgctctctccagttaagtgtgactaccttctgctcaggaagcctcttcagttctacagagcaaagagagacaggagaagccccaggggtggaggtggctgacagctgccctctatactggctggcatttattgagtgcttaccatttgcttttcatgcattatctcttttcatctcaccttgatcctttaagttaaggacttgaacacagagaggtttgcttgcccctaaagcctatccttttaaccacaatgccccactggcattcaccaaggtccagaaagcaagatgaacaagttcatctctcagtcaccattgatctagttccctgagctaagaaagcgggtagagagacagggcaaatctctgggcagaataaaaaggtacattgcgttgatgctgtttaggctggtgcaacttaataaatggaaaaatgctatttaggttgcaccaacctaataaatggaaaaccaagagctgcaagcaggatacagggaggtcagaacactgacacttttttttgagacaaggcctcattctgttgcgcaggctgaagtgcagtggcgtgaatatagttcactgaagcctcgaattcctgggctcaagcgatcctcctgcctcagcctcctgagtagctgggactacaggtgcacaccaccatggccaggtacttgttttttaaatttttttgtaaagacagtgtctccctatgttgcctaggctgtcctggaactcctggcctcaggaaatcttcccactttggcctcccaaaatgctaggttatagtcatgaactcctgtgctgggacctcttgacactttttaatggaaaatttccaatggtggaggcaagtcactagatttagaagttgaacacaacaatggttggaaaatttccaatggtggaggcaagtcactagatttagaagttgaacacaacaatgattggaatatttcttcctaggtggttgaccagtgagcatagttcagctttagtgagcacaagaagtgctaaactgactaaatattaaagagactgactctaggcatagtttcagaacttcccagaaaaatgtctactgagattgagaaggttgattcctggtcacaagtatagggccacattggacataattttttaaaatgctacagtgaaagagcaccaacttgaagtcaaaggaccagggttcttatttcatctttgctactcacttgtgactttggcaagtctgttctcatctcgggccttagttacctcctatggaaaatgaggtgatcaattagaccattttggaggcccctttctgcttgaacactctggaagccagtgactccaagacacatggccagaattgcacacaaagagacgttgttgtctgagaaactgagaagctaatgaataaggtggttgaggaaaaagaataaagcatggaggtggtgacactgcagcacagtgcctgggagcacatttagggactgcgttagttcacatcctctgggcaacacatgctgaggtggagttatgagtgtaatgcctgtgaaccataaaagaagaggaaacagaatgggcagggagccttcaggaggcaatgcagagctaacacctaagaaaggaatgggaagagtaagcaggattgagcagggagacccacggactggaatgcagagatgacaaaatcttgcccaaaccaaaggagagctccagagcaaagactaccccttagaggagtctcacattgaacaaagttggccagaccctagtgtgctcattgtgcacaaccattggctgaaagctgcctaggagaacatgtccttggttcacaagccaaggcacgttcttccttggaagaagatccaagggacacaaagataatgaaattgaccaatggatgggaaaaaaacaagtgagcaagatatctggatttcaattacttaacactttcttatggaacgtcaccttacctagatattccctgaggttaaggtcttgaccagtcctgaactactacaattatccaaatttaatttcataaaagtaagattaggggaacttagcctggaaaaaaaatcataggctattttcaccatgcaaattttccaatagtttgtcaggtttgctttcctgtatagatcttccattagtaaaaagtgtgaagtcctagaattttaatgctgtttgagactttaaacagccactgagttcaactctctgtcactccaaacctctgacggcattccaaccaagaggtaatccaacccctatttgatcatctccagagataattgggaactcacttcttgaaatggccttttaaattaggccctgaacactctaactgctactaagcgcctctttgcaaagagctggacactataatcctgtgctgactgaaacagtccttccaaactgtggctcttgagtcaatggagtttggcattttcataccacagtagtttttttctttgaggaaaaaaaggagactgaggatacacactgagtagccttgttcctggagggctccaggaacagacctttgagagccctttctgttttcagatttgaatttccaaaagctcattttgagccaccactaacagcttggaacttctgtggggaaaactcactaagagcaaggagagaatcaaaagagtctaaatattcacaatagcaaagatgtggaatcaacccaggttcccatcaatgatagattgaatttttaaaaaagtggtacatatacaccattgaatactatgcatccataaaaagaatgaaatcatatcttttgtagcaacatgaatgcagctggaggccattatcctaagctaattaacacagaaacggaaaaccaaacaccacatgttgtcatgtttagtgggagctaaacattgggtacacatggacacaaagataggaacaataaacagtggagattccaaaaggggggaggggggaagagggacaagagttgaaaaactacctattgattctattaggtactatgtttgctacttgggcaatgggatcattagaagcccaaatctcagcattacacaataaacccatttaacaaacctgcacaagtatcccctgaatctaaagtaaaaagtaaatttttttaaaagcacacacaaaaaaaccctaaaatggtgccaatttttgctctggggaggaacatcctcttacctcatgcatcctactttaaaaggtaaagatatttcctgaataaaattcgataaatgatttgaaggtcttaatgaggcagtgacctaagggtgtgttctgaaggatcggagaggtcatgactgattaatttttcactgtctaaatatcgactaaagatgcttcattaacctgcctcagacacacaactcccgaggtcttgctttttccacttgaatttcaagttgtgtttgaaaactccctccttgtaaagaatggtaaacaaatataaaacaggaatgggagaagagagggcactggaagtccacatattacaggttgtttttggggagctggagaactagaaacaacactgaatgagttctttgatagagaccatcactgttgagacctgacacgggtaaagtgtcggcctttgcattaacagaatatcttttatctaattagtcaagtgtcttttaccaaatgccaagtctctcacaaataaacacactgtggatatcagtacaacatggctacaagcatgtgtcagatgaataattaagatgactatgtctttaatatccttgaagtattcggttggattccttttagccacaggctacgttacagttttcttacatggggacttgcagaatcattcaataagcgcccagtggtctgtatgcaggagagtgctagggcccctcccagctgtattgatttaggattctctgagaaaccagctactaaaaagatcgaacaagacactgtttcttctagaagattttcatcaggaatgtaactttatggtttcggcattcctctctccttaaagaaagcaaagatagaacaatgacgtgaggggagtgagattactggtaagaatccatcaattcacccgaagaggcaaggacagacagtggaaagagaactgactggagtttaggtaatatttatcactgacaagctggataaccttgactaagatattgaagctatttgactcaatctataaaatgagtcagatgtgaggcttatacgagataataggaaaatattctgcaagctgtattcttcacatgtgcagagctctcattatgtgttactggggcccaggagaaccctaatagagtggagtattattgtacaggcttagaggcaggctgcctggattcactctcagttctgacctaagcaagatgcttaaccactctgtgcctcagttttcttatctgtaaaatgtggataatacaagcacttatcttacggtattgttgtgagcattatatgagatgaaacatgtaagatacttagcacatagtgcccggcacacatagtaagagttcatcaaatgttgggtgttattattgttgttatattttcagtgtgtcatttattgacatccttgggagactttctccctgttcaatacttgggtatccactaatgataatggtgctggtagtgctggcagtggtgatggtgacacaaataatagtgtcaagatgcttccatttgcattgtgttgcatggctcacatactgaccctacgagttagccagggcaaggatccgtattcctgttctgtgcatgagccagctgaggtaaagagaggtagaagagtcacccaaggtcacacagctaatgagagtggcaggagcactggtacccagggctttggattctgaatccagtgttctttactttttttttctttctttctttctttttttttttgagacagagtctcactctgtcgcccaggctggagtgcagtggcacgatctcggctcactgaaacctccacctcccgggttcaagcgattctactgcctcagcctcccgagtagcagggattacaggcgcatgctaccatgcccggctaatttttgtatttttaatagagacagggtttcaccatgttggtcaggctggtcttgaactcctgacctggtgatccgcccacctcggcctcccaaagtgctgggattacaggcgtgagccaccgtacctggccccccagtgttcttttcaatgtaccctactatcacccagggagaatgagtacctacatgtgtctcatctacaagtcaaatatgtttttctatcaaaaccacactcctatgctcactagcagagtataatgtttacaaaagcaagaaaatagccctgctcttccctggggacattggtcacagatatccttagagcaaaaaaaaaaaaaagatgatttacaaattccatgtacctgcaagagatgcaaattaaatttgtaaaaatatataattattcattaatatgctttgcagcaataagggaaaatattagtaataaatctagaaagtatgtaggtgagggaggactttatttctcatctggaagacatgtgaaacagcaaaacccttctggaaaagtatatgggcagacgttgagaagcccatacggtctcatggtccttttccttgtatgctggctcctgaggggatgattcctaaggaaattcaagagataaaaatcaagcaaataatattaagaatgacctcagcagtcaaaaattgtactgtggcaccctgaaaacaaggagtgaggggcatccgtttctacatggcttaataagatctgtttttaatgaccatggaaatatatactttaatcaaagttatatatatatacacacacacatatatatgtataaagagtgaacagtgccagaaaaatgctatataaatatatatatattcaccaacatacagaatcccatgtacaatggaaagaaaaatgagtgctcagataaatgagagtttcacaattagctttaaaaagcataagacataaaataagttataaagtccgatttctatttctcaagatgtaaaaaataaaataaaataacactcataataggaaaatgagaaataaagtgatcaggtaccttagaacaagaaagaaaatgaaaggttaagacaaaagaagatgaatggataaagaaaatgtggtacatatacacaatagaatattattcggttataaagaaagaatgagatcctgtaatttgcaacaacatggatggaactggaagatgttgtgttaagcgaaatgagccaggcatagaaagacaaatattgcatattctcattcaaatgtgggagctaaaaaaaaatattgaacctgtggagatagagagtaaaatgatgattactagaggctgggaagcgtaacagggaggggatataaagaaaggatgggtaatgggtacaaaaatacagttagatagaaggaatgagatctagtgtttagtagcacaataggacaaccatagtaaataataatttactatatgtttcaaaataacaaagggagtggaattggaatatttctaacacaaaagagataaatgcttgaggtgatggatactccagttaccctgatttgatcattacacattgtatgcttatatcaaaacatcacatgtaccccataaaagacaagtgaactgtgctagaataatactgagaaagtgagaaatgatcagtctgagggcctcagtggcaactgaaaagaccatacttgctttaaaaatgagtattgttcagaagctttaataaagaataaaatataaacaatgggccttggcaaaatgtgaaaggaattcacatgaattacccacaacagtagctgcaaccatgctctgacactctatcctgaaatacctcagtcactaacaccttatttcttctacccaaacactggatataaaggatacagatatcaacaggcatatataagtatataggtatataacaggtatataggcatataaagctatataggtttatatatcaaggatgctcttctaccacaccatgatcacacttgcaaatgggaatggaagtggtggggacagccaacttgggctaaaggccttaacaatactcccagctctccttacccaaggcaactatgtgtgctggaccctcagctaggccctttacatgtgtcctctcctttaattcttacagtggttttatgaggtaaacatatccctacttttatttttcacagaaggaaaccaacactcaaattggtgaaatactctcccaagttttcacatcttgtgagtggaagagccggactttgaatccagagctgtgtgggtgagtcagtgctctaaagctgtaccagccccaatctcaccagacagcaagaaaagtggctgtggtcatacacttttactaccactactgcctactcttttaaaaaaaaaattgtgggtacatagtaggtgtatatatttatggggtacaagagatgctttgatacaagcatgcaatgtgaaataagcacatcagggaggatggaggtaaccatcctctcaagcatttatcctttgagttacaaacagtccaattacactctaagttattttaaaatgtacaattaagtcattattgactatagtcaccctattgtgctatcaaatactaggtcttattcattctttctgtttcttttgtactcattaactaacccaaccacttcctattcttcataaaatgaccttctaggtgtggaaaaccctactttccttaacttagctaggacaaagtggacattcttggagaggaatgtttactataagactcaaaaaaaacccagcaaattcaaaaaggtagatatgaaggcatttgagacttcaataactggagctaaaaaaaaattggttaccaatatggaaaaaattgggtcccacctcacaccatacagtaaaaaaaatctagatggatttaagactttaatgtcaaaaacaaaacttaaggcattcatattgtaagagaagaggttaagttgtctctgtttatagattacatgatcttatatatagaaaaccctaaagactccaccaaaaaatattaaaagtaataaatgggttcagccggcagcagtggctcatgcctgtaatcccagcactttggaaggctgaggtgggcagatcacaaggtcaaaagatagagaccatcctggccaacatggtgaaaccccgtctctggtaaaaatacaaaaatcagctgggcatggtggtgcacacctgcagtcccagctacgtgggaggccgaggcaggagaatcgcttgaacctcggaggtggaggttgcagtgagctgagatcacgccactgcactccagcctggagaaagaacatgactccatctcaaaaataaaaataaaaataaaaataaatgggttcaggaaattgtcagcatacaaaatcaaaggaaatttgttgcatttctatatagtaacaacaaactatccaaaaaataaaattaacaaaacagtcccatttacaatagaatcaaaaagaaaaataaaaggaataaatgtaaccaaggaggtggaagacttttacactaaaaactatgaaacattgatgaaagaaatcaaagaagacaccaataaatggaaagatctcctgtgctcatggattggaagaattaatattgttaaaatgcccacactacccaaaactgtctatagattcaaagcaatttcaatcaaaattcaagtgacatttttcaaagaaacagaaaaaccaatcctaaaattcacatggaaatatgaaagatcttgaatagtcaaagcaatcttgagaaagaaaaacaaagctagaggcaccacactccctgatttcaaattatattacaaagctatggtaaccaaatagcatggtactggcataaaaacagacacatagaacaactgagcagaatacagagctcagaaataaatccgtgcatatatatcgttagctaatctgtgacaaaggtgctaagaatacacaatgggctatcatcaataagtgactttgggaaaactggatatatacatgcaaaagtatgaaattggacccttgtctttaatcacatataaaaattaactcaaaatagattaaagacttaaatgtaagaacctgaaactgtaaaaatcctggaagacatagggaaaaagctctttgatgttagtcttgacaatgatttttttggtgtaacacaaaaatcataaacaacaaaagcaaaagaaatgggtgggacttcatcatactataaagcttccgcacaacaaaggaaacaatcatcaacaaaacaaaacaagcaatgaaatgaaaagataacctacagaatgggagaaaatatttgcaaactatacctctgatatattcaaaacatataaggggctaggtgcagtggcttatacctttaatcccagcactttgggaggccgaggcaggaggattgcttggggccaggagtttgagaccagcctgggtgacatagtgagaccccatctatacaaatttttttttttttttgagacagagtctggctctgtcgtccaggcttgagtgcagtggcatggtctcggctcattgcaacctctgcctcctgagttcaagtgattctgatgcctcagcctcccaagtagccgggattataggcacacatcaccacacctggctaaattttgttttttgtgttttttttagtagagacagggtattgctttgttgctaaggctggtctcaaactcctgagctcaagcaatctgcccacctgagcctcccaaagtgctgggattacaggtgtgagccaccacactcagcatacaaataaaaaatttaaaaagttagccaggtgcggtggcacatgcccgtagtgctagctgcttgagaggctgaggtgagagaatcatttgaacctaggagttcaaggctacagtgaattatgtttgtgccactaccctccagccttagtggcagagtgagaccttgtctctaatacatacatatatataatatggaaataaagagggagagagaaagaattcacacaattcaatagcaaaaataaataaataaataatctgattttaaaaaggacaaaagatctgaatagacatttctcaaagaaagatgtacaaatggctaacaggtacatgaaaaaaatgctcgacatcactaatcatcagggtaatgcaaatcaaagccacgagatttcaccttacaactgttaggatagctatcattaaaaagacaagagataacaattgttggtaagggtgtggagaaaagggaatctttgggcactgttggtgagaatataaattggtacagctgttatgaaaaacgatatggaagtttccaaagaacttaaaaatatggccaggcatggtggctcacgctggtaatcccagtactttggaaagccgaggcgggtggatcgcctgaggtcaggagttcgaaatgagcctgaacaacatggtgaaaccccgtctctactaaaaatacaaaaattagctggccatggtggcgcatgcctgcaattccagctacttgggaggctgaggcaggagaatcacttgaactcgggaggcagaggttgcagtgagccgagatcatgccactgcactccagcctgggcaacaaaacaagactccatctcggaaaaaacaaaacaaacaaaaaaaaacacttaaaattagaactaccacataactcagcaatcccacttctgggcatatattcgaaggaaatgaaatcagtatctcaaagagatatctgcatcaccatattcactgcagcattattcacagtagccaagatatgaaaacagcccaggtgtccattgatgaatgaatggagaaaatgttatatacatatattatagatgggaattcttcatagttcttagctagttcttaggttggatggtggtacttattatgtttttaaaaataaataaagcctgtcatggtctgaggatgatgaagtgccatgagaagagacatatgattgacacaattcatacaacttaattatattaattaaacagaatgatttcattaatttagtatgcatatatatgcaacagaagataattcggccaaagaaagaaggacattatgtaatttgggacaacatgggtgaacctggaggacattatgctaagtgcaataaggcaggcacagaaaggcaaacactgtatgatctcattcatatgtagaatctaaaaatgtcaaccgcatgaaagcagagagtagaaaggtagttaccaggggctggaggaatcaggagatattggtcaaagggtacagaatttcagttacagggtgcttaagtcctgaggttccaatgtacagcatgggtggctatggatgtgtttgttaattttattgtagtgatcattacacaatgtatatctaatcatcacactgtacaccttgaatatatacaagttttatttgtcaaataaatattctaaaataaaaatacacacaaagaaaacaaaacaaagaattttagatgaaaatagaggcaaatgtttttctgatcttagggtaaggaaaaatttcttaaacaaggaacaaaaataagcactaaccataaaaggaaagatcgataaatttgacaactaacattaagagtagaatttgttctaaattgctggtgtacataggtcaaaccactttggaaaacaatttgatatttactggtaaagtgtaaaatttgcatagccaagacttagaagaaaaattcttgcatatgtgcacatggagacacgcgtaaaaatattcataacagcagtgtttataatagcaagaaacaaacaaaaagaaaaaatctgtaaataacctctatttccagcaataggagaaaagataaatgattatttatacactgcaatattctataacagtgaaaaacaatggccttcagttaccaaaaaacaacaaggatacatatagcataaagcctaacaatatgaagcaaattccagaacactatttgacattgatatccttattaaaatgcaataagccaaattaaacaatgtattggtttaggagtacatacatatggaattaaactacaagagaagcaaaggaaaatattaaaaagcaacgggatggtaaccagaaaattcacaattatggttttctctcacgcaggagtagaaaggcagggtacctggagtgaggaggagcacatagacagatgggagttcttcatagttcttaggctggatggtgggttcacaggtacttattagatctttaaaaataaataaggcccatcatggtctgaggttgatgaagtgccatgaatggagacttatgatcaacacaattaatacaacttaattgtattaactaaatacagaaagatttaattaattaaatttaacttctgatgtccggaaagaagaaagaaaggtcagcattttcaagtactgatttctgatccataactaaaatacaatcagaatatagggttttttttagttcatcgtgtttccagtaatatgtccctttgtgaataatatcaaaccagatcaactttctgcagttagaaattgttgacatcgttccaagagataatcacatttttgcctagaaaaggatggttgatggatagcagctctggcagatgtgctgagtacactgtcctgtggctacctgggtaacggttgaacatttaattagaggattaaaatgcatctttctctttttccttcactgacgcaggacatactgtaaacagaagggaatgaatagagaaattaaatatacaaaatatacaatttaatctattagaatgcttcacttatccagcattgctggaaatgaggtgtttttagatgtgaactttgcacataatataaccccttttaacccaagaacgctttaaaaaccattttaatcatttttgatgaaatcttgcaagaaggcttacaaacttgccttctgtttaaacagagtaatattccaagtcctacctttctgcaatgccctagattcatcattctgaaataaaatttatgcattgggcagtaacacaaagctgccatcagaacctatttggtccatgttttcaattgtctcaaattaattcctgaatttttgtttcagctttgtgtagattttccgtaattttcctcctaaccaatctatcagccaccacagctctcagcacacttgcctcctcaagcaccactccctgcttctattgtgtcatagctgcgaaaacaaagagacaagcctcatttattcgctgattcattcagcatttattgaatgcccaatatgtgcaaagcagagatgacataaaggaaacagacactgagcccattctcaacttgcttttgatccagtggtggagaagagctgtgtacataggtaccgaacagaaagtaaagcatgctgtatgagcagtgcagataatgtgccatgggcattctgaggaggggtgaattacgaacacctgagggttcagagaaggtttcttggaggaggtggcatttgatctgggtcttggaaattgatagggttggaaatatggagatggagagaagggcatttcaggcagaaagaggagtacaagcaaaatcccaaggcataacacataatagatgcttaatatattttcttaaaaagttgaatgagaaagttccagccagagcaatcaggcaagagaaagaaatgaaaagcatccaagtaggaaaataaggagtcaaactatctcttttcactgacaatataattctatacctagaaaaccccagagactccaacaaaaggttcctagaactgataaacagcttcagtaaagtttcaggatacaaaatcaatgtgctaaaaaatgatgagttcatgtcctttgtagggacatggatgaagctggaaaccatcattctcagcaaactatcgcaaggataaaaaaaccaaacaccacatgttctcactcataggtgggaattgaacaatgagaacacatggacacaggaaggggaacatcacacaccggggcctgttgtggggtggggggagcagggagggatagcattaggagatatacctaatgtttaatgatgagttaatgggtgcagcacaccaacatggcacatgtatacatatgtaactaacctgcatgttgttcacatgtacctaaaacttaaagtataataaaaaaatcaatgtgcaaaaatcagtatcatttctatacaccaataacattcaagtggagagccaaatcaataatataatcttctttacaatatccacataaaaaataaaatacctaggaatacatctaactaaggaggtgaaagatctctaaaaggatgactacagaacactgctgaaataaatcagagatgacacaaacaaatggaaaaacattccatgctcatagattggaagaatcaatatcattaaaatggccatactgcccaaagcaatttacaagctcaacattattcctatcaaactatcaacatcatttttcacagaactagaaaaacttttctaaaattcatgaaaccaaagaagagcccaaataactaacatgatcctaaccaaaaagaacaaagccaaaggaatcacattacctgatattgaactacactataaggttgcagtaaccaaaacagcatggtactgatacaaaaacagacacgtagactaatgaaacagaatagagagcccagaaataaagccacacacctacagccaactgatcttcaacaaagtcaacaaacataagcaatggggaaaggaatccctattcaataaatggtgctgggatagctgtctagccatatgcagaagaatacatatggccatctatctatctatcaccatttacaaaaattaagatggattaaagatttaaatgtaagagctcaaactataagaatcctagaagaggccaggcacaatggctcatgcctctaatcccagcactttgggaggtcaaagtgagaggatcgcttgaagccaggagctcgagatcagcctgggcaacagaatgagacctcatctctacaaaaataataataataattttaaaaaagattagcccggtgtggtgatgtgtgcccgtagtcccagctactcaggattctaaggtgggaggatcacttcagcccaggagtttcaggctgcagtgatctatgatcataccactacactccagcctgagcagcagagggagatcctggaaaaagaaaaagagaaagaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagagagaaagaaagagaaagaaagagaaaagaaagaaagagaaagaaagaaagaaagagaaagagaagaaagaaaggaaggaaggaaggaaaggaaggaaggaaggaaggaaggagaaagaaagaaagaatcctagaagaaaatctaggaaataacattttggacatcagccttgggaaggatttatgactaactactcaaaagcaattgcagcaaaatcaaaaattgacaagtgagacctaattaaaaagcttctgcacagcaaaagcaattatcaacagagtaaacctacagaatgggaaataatatttgtaaactatgcatctgacaaaggtctaatatccagagtctataagaaactgaaacaattgaataagcaaaaaacaaccctatttaaaaatggggaatagacaagaacaaacacttctcaaaagaagacatacacacagccaacaaacatgaaaaaatgctcatcatccctaatcattagagatatgcaaaatgcaaatcaaaaccacaactaaatatcatcttaggccaggtgcggtggctcacgcctgtaatcccagctcttagggaggcagaggcgggaggatagtttgagtccaggagttcgagacctgcctgggcaatatagcgagaccccgttctccacaaaaaggaagaaaaaacagacaaaaaaaaagtgaaatatcatcttaaaccagtcagagtgactattattaaaaagtcaataaaaacaacagatgctctcaagactgcagagaaaaaggaatgcttataaactgttagggggaatataaattagttcagccactgtggaaagcaatttggtgatttctcaaagaacttaaactagaactacccttcaacccagcaatcccattactgggtatttacccagaataaaataaatcattctaccaaaaagacacatcacctttatgttcattgcagcactattcacaatagcaaagatatggaatcaacctaggtgcctatccacagtagactggataaagaaaatgtggtacatatacatcatggaatactaggcagccacaaaaaagaataaaattatttcctttgtagttacatggatacagctcgaggccattatcctaagcaaattagcgaagaaacaaaaccaaataccacatgttctcacttatgagtggaagctaagaattaagactattttattctaggacatagataacaattgaagattttgagcaaagacttggcaatcaaaattattatttcaggtgattggcaataagatctgcacaatagccatgcaccaagaattgagaagagagatattagggaagtgagattgataggaggtgtctaccaattgcatgtagggaataaggcatagagagatttggagatctcatgtaccccataaatattttttaaaaaagataatattcagctttgaggctgatttaactacaacgaaaataaagatatttcagggaaggggggaaggttggtcaggaagatgtgatagacaggagaagaatgagtttcaatttgggtacattgagtttgagagttataggtaaacccttgggtggcattttctgctcagcaggcagttggagctctttagagatattggggctgccaaaaggatttgggaatgaatactatacagatgatcattgaagccatgtgagattgtcactggtcaagattttaaaaaaagcaagcacccatatagccaagtttttttttttttaattgttgtttttctcctatatatgccattgtaatccattttcttccaaacatggaacttgtaaaggacttttatgaaataccagttggattttcgcaactctcaggttacagaaggtaagacatttactagtagactgacatgatatggttccaacaccacatgaaagctgagacttggtgtctgtgaccaacacagccatcaatgatggaagagccagtcattaggatggctgaccatctaggggaccttcttgaaagcaggggacacatcagtgaggcattcgtgagcatatttttccactgcaaaggttctcttaaccccgtcaacccacttccaccctgaagcacacttgagattccagtcctgaggatgtagggggatcatgcagagttggttgagcctctttcacagatagagtcataggcagaagcaacatttttgaagtgacacatacatccctgagaaaggaggctgagggccttatatttcatcactttctgttctcctaaccttccttagcatcacatctcatcttgtctggtttaatctggtctgcttttgtctcatctcaattcatctcacttttacagttttcaggcatagattcattcaacaagtgtctcttgagtgactatgctatacaaagccgctggctaggtaaatgcttcaggagatactgacaaagctcagggtcctgggactaggctgtctccaagctgctcacaacctatgaggagagagagaaaaagctaccaccaaactaattggaggatggagaaggatgccatgggccgagaaaaaagaatgttttttccatggagagagttagggaaagattcaagaaaaaggtctggcagcaggaataaaagacagacaagaggaagcaatggcatccagacagggaaaagagcactgaaaagacttggagaatggaaaaacatggttctgtataggaactacaagtagcttagtaaggccagacggactgattgatagggtcacagagagagagagtgaaaggagatgaggatgaatatgcaggaagggagcatgctgttcagtgcattatgagcaaggataagtaagagtgctgatctttattctgtagggagtaggaagccattaaaaggtgctaagtcaggagggatgacttgttcagagtcaccaacttaatggtccatgaaggagactcaagtgtgacccaacactgtagacttctaatgttggcaactttcctcattgtttcccaatatgtcccttccagttctgttttatcctggcttctaactttgttctccattttctatatataatcctgcttctgacatttacagctgatcttcttgaattaagattctctgctctcctatattatctgtgtattggacttgcctctctggcttgacattgaagtctgggaccatttgggataaaatattaagctttagctagccctggtccattgaccataagctgattccacttgaaggtgtcaggaaaaatagattaaaggtagaggcagtacaactgaaataaagcttcctaaagtttgtgtaaatatgatgaagcctttttggcaaatacaccataagtgtctagcaagagaggaagctttggagtagccaggacttgcatatttttagaactctgatagtgtgaatgccatggtgcaaagtcaaattcagaagcacttgtaggatactctgaagatagcagccccagaaccacactttgagaaacactgaactagagtacagggtgcttacagggaaatgtacattacagccagggataacagggccaagttaccaggggccttcaatgccagaatcagcaaccagggtcttggactttctgtgctaagtgattaatggaaaggcaggagaggctttgtggcccagggtagaagcaccatgagaactttagtctggtgggagcatttacctcatcaaagaggagatgaggaaccagtgtggagtcagggagaccagcaagggcactggtgcaagaatcccaggcagggtgtggtgatgaatgagggcctggcttaggacaccctccaaacaaatgcattcctactggatgctcatggacagagaggagagagttgcttccaaaaacccaggccaggaaataagaaaagaagttgctctttcccctcatggcatgtggaattttgctgatgatttattggaattcttcccaaagctggaatgacccaaataactcactgaagccattcggaaggggtctgatactagagtttgctttaagaagtcagctctgcagagagtacctggaggtaatttgttgtggttggaaagacagataaagatattttccaaaattttattctgggagcagagtgcattagtgctgaacagcacttaaaactcagttctctagctgacaacaggcaaaatgaattgctgtcccactgagctgttaactaaatacttacaacttctaacccagtggtcttcagactataggatgcatccaaatcaattgaggtatctggcaaaatgcagactcctgctcctcctgcaagattctaattcctacagctggcgaggagacctgagatctacatttccaaacaagtccctcccctaggagattcagatgcaagtagtcaaggcccttgctttaaaaatcattaccatataaagctcaaccatcacacatacacacacagttatcttggtctttgtcttttcaaggttctgcgttaatcactttgaggggttccgaggtacagaagctgagtccttatcctcacattgtctcggaggtgagctgggcatttcatggagacagtgtcaagagctctaaaatgggcaggaaaaaaaatgccaggttggttcaaggaagggagagagcttatttactattccaattgtctttatgagaccagctgcagaggtagtctagaggtagagaaataacaagacttattataattgttgaaagcaatgcagactatgccttagcaaagcctttcacaggcatcctttgaaaagcaccatgttctatgagagctcattaaataagaaagaacaagaatggcccatgggcaactcaaagagtaaatcagtgtagtggtttcctctactgcatataaccctgggccacgataattctccttgactcagctggcagcaatcacagaaataagcttctttgacttccatccatagctgtggcaactggagcctgagaggtgaaagcccctaaccaggtcgtctagactgtggatcaggtgccagagttctttcccagctcctacaggccaggggtggaaggagcttgaacagaccttgttcctgctagtcccttgctctctgtcatcttctgatggctccagttagaacactgaatgcctactttaggtactcaaaaagcacttctccttcttagcacatttctctgtgtggttttatagtggtgatactgtacaagctaacacttttgagcacttactaggtgccaggcattgatctaagtgatttttatatactcctgacaaccctattaatatatccatgttactcttatttatttttaattaattatttattttgaaaatcaataaatattgtatacatttatggcttacaacatggtcttaacatatgtatgcattgtggaatgtctaaatcaagctagttagcatatgcattgggcaaggcagccctaaagcccatgcttatatccaccatgctgtattacttctattgtgacccaagtcagtctcccctaccagactgtaacctctgggagaacaggaacaatgtctatcttggtcactgctgtatttcctgtacctgacaaaaaatagacgttcaagaaatgtttgttaaatgaatgaacaactgacactgataaaaatttttccgtgctgtatttggaaccagtatacctgagactcagtccgttttcaccattaatttctataaccttcattaagactttgctagtttcaggacctcagtcttaacatcagtaggataaagatggtgctttctaagggacctgccatatacgatagtctagaatcttctttcccatcactaaatccaagcctccaggcagttcttgaataaggccaacccaaacccatggcatgatcttgcccctggccctgagccctttcaggtatgccccaaatcttggtattatgttcaaatgtatgggataataaggtaggtaggagagagaggaagaggttaaaaatgtgggaagttgggaaaaggagagattcttgagaagtttggagctagagaaagagaacaaagaaatatttggagtttgctggtcatttgcaaaaagaatccatcctcataggtgtttttggccagagaataaattatcaagcagactctacctatatggtaatcaaatactctgcatactaatggtgcttctaaggcaggtatagcagaaaggacaagaaacacttgaaatgcaaaacattcagaactccaagaccaaagatcaatcattccagatcccagaagataagccaaagttgcctcgcagcttgatctggggttagcctaacaatcaaatgaatataagactttggcccctagggactcagagagggaggcaaagttctggggtccagctggcccaggccagagggtgttggaatgatctagggaagatggaggctagctttcctagctccttaaagaagagggggaaataagggagctcaaatttaaaagatatacagccttatgatatgaaaattattcccccaccttacagatgaggaaactgagattctgaaaagtgaaataacttgccccaaatcacacagtagtggagcccagaattaaagccaggcctgtgtaactgaaagccccctctctctcagcttcaacaggctcctctgcttaagccctctttgactaatccttaatggctaattagttgtcccatcattaaaaggaatcagagaaaggcaaaggaatggggctcccatgacctgctgaccctgttgtgtcattaaaaggagatagctttgagtcgaaacttggtgggtttcttctatatgagtctcattttatccagcatcctcttgcttccaagaccctcccctccactcgaccccacacacacaaatccttattacttatatttttctgttttaagaaaataagttaatatttataaagttcttagaacagtacctgacatatataattactataagaatgtttgttaagtaaactagagcaaacattatcattaaaaattccagataatgcaaaaatataaagagaattaagaaaatcacatataatcccacactagaaaacccataactaaaattttgatgtaggtgcaggtgtaggtttctttatcgtgtacaaagaaacattttttaatgaaaaagaaagattattttatgcatattgtttttgtatccttattttctcacagtaatatgctgaggacatcgtttaatgccagtaaatacagatttacattatcatttttaacacatccgtaatattcattggtgtggatacaccaatagtatagttaactaaattccactgacaaatatttcaattatttctaatatgttgtttttgtaaacaagactgtaacaaaaaccttgataaaaacaagctctccttgtgatagctctttgcatccttcatgcattcctccagatcaccctgcagaaagtttgcaccattctaatggacaataaatttctctgattaatagtttgattgaatatattttcaaatctttattaacttttgatctcttttccattcatgttctttgctcgtttttctttttcttatagatttttaagaacttttctacattgaaatgattaactctttcgtcatgtatgatgcaaaatattttttgcaatttgttgtttcagtgggctgtgcaaaagttttggatttatgtgtaacagaatctgtcaatatcttgcattatagttcttgtctttaagaaaaaaatgccttctgcccttcaagagtgtaaaaatattcacttatatgttcttctacatatctatggttttatttttcacatttaaatatcttcccgacttagaatttgccatggtgtatttccagggactttaaaccaacccttcaaatctttgacattaaatttctaacatactcttttcttgaatgaggaaaaatgaggacttctgtatctctgaagaaaaactgtaatatagaaactgaccagcatttgagcctatcattcaaagacttgtagtacttttctcagaatggcatttctttttttttccactatttatttatttttttattttattatactttaagttttagtgtacatgtgcacaacgtacaggttagttacatgtgtatacatgtgccatgttggtgtgctgcacccattaactcatcatttaacattaggtatatctcctaatgctatccctccccactccccccaccccacaacaggcctcgatgtgtgatgttccccttcctgtgtccatgtgttctcattgttcaattcccacctatgagtgaaaacatgcggtgtttggttttttgtccttgccatagtttgctgagaatgatggtttccagctttatccatgtccccacaaaggacatgaactcatcagtttttatggctgcatagtattccatggtgtatatgtgccatattttcttaatccagtctatcattgttggacatttggcttggttccaagtctttgctattgtgaatagtgccgcaataaacatacttgtgcatgtgtctttatagcagcatgatttataatcctttgggtatatacccagtaatgggatgactgggtcaaatggtatttctagttctagatccctgaggaatcgccacactgagttccacaatggttgaactaggttacagtcccaccaacagtgcaaaagtgttcctatttctccacatcctgtccagcacctgttgtttcctgactttttaatgatcaccattctaactggtgtgagatggtatctcattgtggttttgatttgcatttctctgatggctagtgatgatgagcattttttcacgtgtctgttggctgtataaatgtcttcttttgagaagtgtctgttcatatcctttgcccactttttgatggggttgtttgttttttttcttgtaaatttgtttgagttcactgtagattctggatactagccctttgtcagatgagtagactgcaaaaattttctcccattctgtagattgcctgttcactctgatggtagtttcttttgttgtgcagaagctctttagtttaattagatctcatttgtcaattttggcttttgctgccattgcttttggtgttttagacatgaagtccttgcttttgcctgtgtcctgaatggtattgcctaggttttcttctagggtttttatggcttcaggtgtaacatttaagtctttaatccatcttgaattaatttttgtataagatgtaaggaagggatccagtttcagctttctacatatggctagccagttttcccagcaccatttattaaatagggaatcctttccccatttcttgtttttgtcaggtttgtcaaagatcagatggttgtagatatgtggcattatttctgaggcctctgttctgttccattggtctatatctctgttttggtaccagtaccatgctgttttggttacggtagccttgtcgtatagtttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcatatctcttgtaagttggattcctaggtattttattctcttagaagcaattgtgaatgggagttcacccatgatttggctctctgtttgtctgttatttgtgtataagaatgcttgtgatttttgcacattgatttttgtatcctgagactttgctgaagttgcctatcagcttaaagagattttgggctgagacaatggggttttctagatatacaatcatgtcatctgcaaacagggacaatttgacttcctcttttcctaactgaataccctttatttccttctcctgcctgattgccctgagaatggcatttcttttcacagaaatgctattctgcctctttgtctaccagagctactcctttgctaaatactaaatgctactattgattgtagagcctgctcaccttcgttaacaaagagtttcaccaacttgaagacttttttttccgacttggttgatcactcctactgaagatactgagcttcttttatttgtttatttatttatttagagacaggggctcactctgttgcccaggctggaatgcaatggcatgatcactgttcaccacagccttggcctcctgggctcaagtgattctctcaccttagcctccccagtagctgggactacaggcacatgccactatgcccagctaattttttattttttgtagagacagagtcttactatgttgcccaggtcagtcttcaactcctgggctcaagtgatcctcctgcctcagcctcccaaagtgctaggattacaggcatgagccatcacacccagccggcctctttattaagaagcaaatatgttggagcagagagggaaggagtgcaagtaacagatcatatggctaaggagaatctattaaaatttggcatgggtagtaggtggggagtaaaaaagaaatgagtgacaagcgagagagctttttagaacttacctttggggagcagaagccagagtgaatagagtccagcaattgccaaaagcaatgatgtagaaatgctgaaaagtattaactcaggagtttggaacctggaattctggtcccagttcttccaacatgtggctcagacatgcatcctccatttctctaggtcttgatttctttatctgtaaagcagtgtaggggtgcgtgaaggggttgtgtgtggggttgattagattcaattcagtggacatttaattggatagcaattatgggctagacactattctaagtacttggttaactctaatttcttccagctcagcaattctatgagggttgttttgttcatatttcttgagtattgtgaggaacattaaaattttccagaagttggaccttctggaattatctagcacaagaactgagtagggtctctcttcagttccagaaagataggagggtaggtagagcaggtgtggggaggaatttggatggaataagaaagaagcaatcaattggatcaaatatgtgtaccttgcctgtgggtctgttttgaaatacacataatgactaccatctccaacttttccagcaggctaggtgtttgaggcttttctcccacaagaggatttcatcacttatttactcttccattaatgaagtaaacattgactgaggcagcatgtgcaaggcactgtcggcttttgtttctgctcattggcttttcattgagctttagcattagggccctagttaattgcttgctttattttattttatttagagatggagtctgtctctgtcacccaaactggagtgcagtggtgtaatcataggtcactgcagtctcaaattcctgggctcaagcaatcttctcaccttagcctcctgagtagctgggatctcaggcatgttccaccacttacagctaatttattttgttttattttctttttagagatagagtctcactatgttgcccaggctggtcttgaacttttgggctcaagttttcttcccacttcagcctcttaaatacttgggattgcaggtacaagccaccacacccagcttgcttgcttgaaatgctatcctgcctctttgtctacaagagctactcctttaggccaaagtatacattttcaaagttgcttcagcccctgcaaatatttttgacaattatgagattgtatttaaatacccatgcataccccataaatatatacacctactatgtacccacaaagttttcttttaatttttaattacaaataaataaatattcatgccaccctgtttatgccccatgctccattagtatactgacatctgagactacatgttttgttctttactgccttttaaatcattttcccctaagaattattgggcatctttataattgtctttccttttctgtgccacattccatgtcttctgacgtgtctatattcataagataatctgagcgttccatctctacttccttccatttttttactctcaatttttttatgattctgggcatccattctttgacttagcatttatagaagccctgcccagtgtgtacactgttgcaagtacagcaaatatgacaaggagaaaactaataaggtccctccccttcatgcaactccattctatcgggggaaaacgacagtcaacaagtaattgaacagcactaatttatcagcacttgaataaactgccatggaggagaatggagttatcttgaaatattcaaatatctagccatagtcagagatatagaaaatctactctttcccaacaccaaatacatttccacatgtgactctctcttcctttaagcttgaagaactaatgaaaacagtatccatgtccctagtcttcatattaagtccagattgtactctactccctaaagctcccattgctgctgtggcaattaagatgccatccagaaggaaattagttctggagcagtgatggctcctgcccaaacctcagccaggcccttgctaggagctgtctcgaaggccagtctgagcaggcttggcctgtctccctccactgggacagctatactcatctcttctcccctgactcagtctcctcttctccccatcttccctcctggtcccttatggtagcccagccttatctcacctcgcagctcctcatcttgccagatacatgagcccctttgcccttctcccatgacctcccaaaaatgttactgttcttcatgcatcaagcaccctctcactcttcttctcactcttcttacaggagccaaagcaatagtgtcttgagaagacactatttttgagaagaaataggcatgaaagtgtcctttcaagttaataattatggaggtcattggtgacttgtctaaaacaactgcatgggattgtacaggactgaggaactggaattgaggtagtagagaagatgactgtatataacttttttgagaagtttgtgaaaggggaagagagagcttgggtagtagctaaaagtgtgtgtgaaattaaggagagtggttgtttctgtaagacaggagagacttgagcatgtttaaatgctgtttggaaaaatctggtagaaagaagagaaaatacaagagtgcaaagatgattcaatgagtgagttcttgaggactgggatccagggaatatgtcccaggattggattagacagaaggaaggaaatttcttctgttataagtggactgaaggagatgggtacacatgcttgtaggcttaggggctggaaattgaggaaattcccacctggtggcatctattttctctgtgaagtaagatgccaggtaatctaaagaggaaatagcggggagtggttgaaggcttgcaaaagatgaactttttgttttgtttctagagacagggtctcactatgttgccctggctgcatttgaactcctgggctcaagtgattctcctggctcagcctcccaagtagctgggactacagccatgtaccaccacacccagctcaaaaaactgaatgtttaaagagataattataaagaatggaagagcaaaggacattagaagaacagtcctggttgaggttggtgaatatataccagtacccatctgtgtatgatgtgggttttttccccagtatcactcatcggcttaaaggcaagcccagagaaaacttaggttgggttcacctaagtctagaatttttcagtgtactgcaacagatcagtaatggagtgagggagctgagaaagttggtaaaaaaagtaggtgaattcagggctgccactagggtgtgcagagcgctacacaaatatttttgtgggctcttcgctatacgaacaatttagtgaaaacatgtattgtaaaattcatgggctcaaatgagctatagtgatttgttgatgaagatttagcataataagggcagaggaggtacttagctgtttgtttactgtgccattagtgcttgtgaagtttccctatagggttcaggttccacatcttcttgcctgggctcagcaagcatgtctttatgttcctaattgtctaatgcaccacacatgactaaggtgatatctcccactgagaagaaaagagagcatcactgttgttgctcagtgtgccatggctcttgagcacctacttgtactgaaacagtctagatcttcttgcctctacaggcccctgatacccttaagttcattcaggctacaccaagacccatgacactgccattatccaccaggctgcctgtgaatatcagctccctgtggactctcagacgttgttactgtgcttcactgatgagcacaaaggcacaccttctccagagtgtgcaggaaaatgtgaacaatatatcattttatggtcatgttcagtataccatttggcactttatagcacacatgtagaatgacacatcttccaaacatgttctctcttgaaccccataggccataatcacatccatctctttctatgttgactggacccttacattctacacaccaccaccagcagggaggatggactaggggcccattagtggagtgagaagaggggtaccattcatgtaaggaatgtctgtccatcttctggcagggaataagatcaactttggagagcatggcatcaccatattgatcacaggcaagagaagatattaatcagagagctctgttggtgatgaaaaccaatgatctcaaaagctctcagaggagacaggtaacctccagaagacagcttgacaagtggcatgaagcctgcagaggaggtggaataacaccctgggtgccagtagtggtaagtgggggtggaggaggcacacaggttaaataatacctgccaccacctcccccaaccattgagtgctgtagacagaaagtgggaccacggtctgatgtgcatatgtggcacaagcccaggggttactggtgaatgattaggagccattgtgagtaagaatcacaccaaatcagcatgtcatctctattctggcagcctacttttcccctatgctaccaaggaaatattgcaccagtcaacagaggtatcttctcaccgggcctaccacctggaaccatggcgcagccattaagtcttgggacaaccctataggtgtagatgtccagagctccttgtggcatctgatcaaccccacatgtgggatatagggtctgagagttctgtggaagggaagacgtggggatggaggtccatgagggtcttggttcaggctcaaggtgctctgcctggccagcactgctgtccttgagtagtccaaggcatgggacaagggggactcagaaaatgttttgagggctctccaaagcatggtgcttcttgaaacatgaggccagagcagggttcttcttgccgcagactaagaacagtactggatgaagtgatggaccatgtggggtctaagctggggagggagggaagggaagacaggaggataccaatggataggaaaactgaaggatcattgctttaaagtactgatatagttgaataactgataaactgagaataaatacattagcaagctggaagttgaggagatcaggtagtacataagccatatgaatttgtgatttcaaaagtacagcaggtataagtgataacttccagagtcaccatggctgtgatggagtatatgagagcactggagatgaggtcaggaagctgacaccaaggtgctgggggattcattctcatagatgccaaggtcattcaagatgagagcaatgtttgggttggaaaggaagactgtaagaaagaggccggatgtgttaaggaatgaggggaggcactgaggagggcagtagggcttccaagtttcatagccccaggttaatggttctaaagagaagatactaccttctgttcactcatttaataagcatttataaagtgcctaagatagatatataaacaaggcattataatttctctcccacttgattttgtatttattgagtgcagggacctaattaaatgcttgtgaaatgacaaaataaacatcagacactctcgcagtgtcgacagtttaaagaaaataataagatgtaagatgctcacagtgtagtagaagagaaaaaagataatggctcacatttatctagatcttagcatgtgcagagtgtattcccgtacgttacatctttggaacctaccaatcattctgcactatagacaagccagggattagtatctacattttacatatgagaaaacaggctcagaaacatgaagtgactcacccaaggccacagggttcacaagcatcagaggcaggattccaagttctcgcttcctgccatttgcctaattggcattgctttgtcaccaccatggaatacctctttctcaatggcatgaacatcacactgtgaggaggactgtctgggtttgggtcccctctccacttttcctttgtaaagcaattttctcaaacacttcccacaattactttgcccagcagtttttgaacaaaggaatatagcacgtttcatttgagagtaacctcagcctccattcgaagtctagaaaacacataataaaactgccctgaactctcttgctttgagtctcatttttcttagttttttttttcccctcctaaactgcccgtgttaaccacacatggtgcatttagcaaagtgctgcccacagaacaggcattgaaagcacaggctttagaggttgcgaagcaacgtacggtatttagaaaaaaaaaaaatgcacgtccataggaaagtttgcctttcactgaaccaagtgtttcctcttacattcccctggacctgctttcaaactctgtcctttgttgctttacaaaaagattgtttcttcattagcctttaaaccctgctgataatagactctggaattccttaagagctgtgcgatggggaggggaatgaggcaggtgggtggttgcactgttagcatcttatcaaggcattcccattcttgttctgtgttttccagtaactaatatcctataaaagcaaatgattcatcagtatcttggtctgatatttcctatgtggattaggtaaaaaaatccctcaaatttgtagttgtcagtccaaataggttctttctctaagcttcaaagttacactccagtgtcacttcccaagtggacttacgaagaattctccaggaacgataggggtttatttgaataagcagagtcttggcactctttattagggcactcatggctggcctgctgcagtggcctcctaactggatggctcttctccattctcagcccctctcttcatccaccaggtgcatcctgcttgagctacttcccaagggtcacttttgaaagctcccccattgcctatagaatgatatataagtttcttaatctggcacacagggctgtctttaaactgacttgcttctactctgcccttgcctcaccccataggttttcatgttcaaaacccctattctacctcatgggtctagtcgctgacctaaaagcgccaagccagaattccttcatgtctgtctggaaggcccttggatttggactgaggaatgatccaatccactgccagtgcctcagcaatgtgctggtttcccttgctctccatcctgactgagggtccgttgaaggaagtatgggatttttcagagaaagatgctaactaggtaacttaaagaaaataatgcagaccaaatgaaagagcagagcaacaatggaattcacagaaggcaggtgtctgattctaactttagtgatttgcccccagtcttgtctggaagagctcatgagggtactcaacctctcaggccctttgctttgggttggatgctggaggccagtgaggggaccaaaatatttgaccaagcaacctagagtagattcagactatggcatctgccggatgtggtgggcccataaatcagttcttgcattgagatctgctcttcagctgtgtgtccctggctctagattacccctaactttcatttctcactgatactttcatttgcaagaatcctgattcttggagcttcctctcatatatagacccacggagagaaagattcttctctgattaaccaaaacttttcatagtgaacatgcagatgagcactttgtcgtggtcccactgactaagggaaccactattctatagtagtaaccaagctaaaaccaagaggtttctctctgtgtctctctttttctctctctttctgtatgtatgtgtgtgtatgtgtgtgtgtgtgtgtaattagcttgcttttctgtcagactcatcatagctggcattatgggccccgccatgcagcctccaaggtaggtttctgaatggtccccaagcagactgtccaaaaggtccccaagcagactgtccttagctttggcttggtctcacagcctgagaggctgagcctgctggtgctgtctgtatacagaacagcgccatgacctctgaggcgctcctgaaagggaagtacctgcatcttggtgcatgaattatgcagcattcattttttattactgagatatttgatttaaagaggtggagattgtcaggctgggcgtggtggctcacacttgtaatcccagcactttgggaggccgagccgggcagatcatttgaggtcgggagttcgaggccagcctgaccaacatggagaaaccctgtctctctaaaaatacaaaatcagctgggcgggttgcccatgtctgtaatcccagctacttaggaagctgaggcaggagaatagcttgaaccgggaggcagaggttacggtgagctgagatccagccattgcactccagcccaggcaacaagagtgaaactccgtctcaaacaaacaaacaaaaaaagaggtggagatcgttaagtatttttgtttttcttccttgttttttcttgactatgttatggaaagtggaagttgttggattagggattaagtgagttgtcatccagacaattagagcttgctccaacaagtctttaccttgctccattctatctcaaaaatgattaatttaaacaaattaaataacaaatatttttctttaaagttttgactctattccaccacagaaattatatgtcacttgatttcagagagtcagagttcacagaatttggctactactattctctatgacttactgttttcagattttcttcctataagatactttagaactgagggagaagatccattccattgtgtaacattatatatgtgccacagggcatgaaactgcttttttttcttatatagaaagatatttcttcaataagagatatatttaataatgaaattataatataaacctgaaaacaggaaaaacaataaccctggactctcagaagcaagaactggtagaaatttcagactcaaaaaaatttcagactcacataatacaaacctctcattttacagaaaagggaaattgaggctccaagggggctcttcttgtccaatattgtacaactagttaatggcaatgccaggcctcactaaatctcaggcagagtcttacctgctaaatatgtgaactaaaagattgtcagatgaaatgattggaagcctggggttggcctcaaacaatccagggcaaggaaaaggggacaaaaagggagttggtagtggagaggaagcaagcttggcacacatggatgattgttgaggctggatgatgtataaatgcatagtcattatggtctctctactgtacatgttgggaattttccacaagaaaagatttttaggccgggtgcagtggctcacacctgtaatcccagcactttgggaggccaaggcgggcggatcacctgaggtcgggagttcaagaccagcctgaccgacatggagaaaccccatctctactaaaaatacaaaattagccaggcatggtggcgcatgcctgtaatcccagctacttgggaggttgaggcaggagaatcacttgaaccccagaggcagaggttgtggtgagccaagatcatgctgttgcactccagcctgggcaatacgagcaaaactgcgtctcaaaaaaaaaaaaaatgttttttaaatgtagggtactttcagtctaccaggctattccatatagtactcgccacaatatcttggaaccggtaggtattcaaatgtgagtgttgtttgactgggctgatgaaggataaagaaagagaaacgaccgggcacagtggctcatgcctgttatcccagcactttgaaaggccaaggcaggtggatcgcctgagctcaggagtttgagaccagcctgagcaacacggtgaatccgtctctactaaaatataaaaaaattagccaggcgtggtggtgtgtgcctgtagtcccagctatttgggaggctaaggcaggagaattgcttgaacctgggaggcagaggttgcagtgagccgagatcgcaccactgcactccagcctagacgagagagcaaggctccatctccaaaaaaaagaagaaagaaacagaaatatatcatggaggttacattgctagcctctgcaggcagctccctcctttgaaggagagctcatgctgctacacaactgccagagcctgttaattctgacattgcaccttagttctgaagtaaaataacacccctttcctctctcttctgttagtggctgtggtgggcaggagaatggcctcccaaagatatctgtgtcctaatccctggaagctgggaatatgtgagtttacacagcaaatgggaattaaggtagcagatagaattaaggttgctaatcagatgaccttgagatgagatcatcttgaattactgaggtgggtccaatagcattgcaagggtccttaaaaatgaaagcaggaggcaggagagcaatcagggtcagagccgtgccatgagagaaggactcaacaggccattgctggctttggagatagaggaagggaccacaagctaaggaatgtgggcagtctcgggatgctgaaaaatgtatggaaacagattctcccatagagcctccaaagggaacacagtcctgccttgacgttagcccaacgagaccacgagacccagttcagatttgtgacctccagaactttaagataataaatttctgttgttttaagccaccaaatttgtagaaacttattacagcatcagcaggaaactattacagtggctaagttccactaatgctacgtcactttcctgttttgattttaatttatgcatgttatctttatgcactactactgtatattcaacctccattgtcccatctttgctgcaagtcctatatgtcttttgtcaacatcacagtggtcataaatgcaagtggcagcaaagaaattattgggagtcaaagtgttgatgaaatgttactttcagagccctgcctgtgctgcctgtctttctgtagttttcccccatgtgttagttcgttctcacactgctataaagacatacctgaaactgagtaatttatgaaaagaggtttaattgactcacagttccaaacgctatacaggaagcatggttgggtaggcctcaggaaacttacagtcacagcagaaggcaaagtgtaagcaagcaccttcctcacatggcagaacgggagagagagagtgaaggggaaggtgccacacacttttaaacaaccagatctcctgagaactctatcacaagacggcactagggagatggtgctaaatcattagaaaccactcccataattcaatcacctcccaccaggctccacatccaacactagggattacaattcaacatgagatttgggtggggacacagacccaaaacatatcaccctgtgttctgttatctccatctttgttagttgacatatctagttatgtagccattttatcttggaagaaaatgccaacaatgttctatttaataaaaaacaaactttatactcagtcttcaatgtgcttgccaaacgtgatggccttaagggattggaaatgaggggagatatgttcctgaaaaattcagtgctcaaatgtattacagcttatcagttgtacacttgtggggcaggcagattttatcaaattctgtaggcaaggtgttcaaacttgacaaggtaagtttgagataaagtgaattctcaataatttattttcaagttttcaagagccatattttatttgtaaatagttcctttcatgggagtagacttccttctttcacctcaagaaatcagacatgtataattgatctttgggtggaagttaagattctgagtcactccttaatattctgtaggatttactaagtttagaagtgtatcatgaagatgagaagtgagagaacagttttaaggctctcaaggttaggagcatttaggtgatctgtcaccagttcatggattgatataattgcaagactggaaaggaccttcagggaattccacagtagctacacccctctgatgcctgagggacatcactgccacattcccaccaaggcatggccaacctctggctcaccacatccagaggaaaggaactcactaatcctgaggacaattatcctacttatttgacaaatctaaaagttagcaagttgttccttatattgagcccaaatctgttttctggaggcttccgatgttgccctcgtactacatgttgtgagtcctgtaaccatcctctcaagtgtagtggttggacaatacacatgctgtaaaatacatgtattaaacatttattgatgaagttcactgtaattatcaagtgatacgactaaccccttgccggttatagggaatacattttcccagaggtaacatggtgcaggatcatcttcaactttgtgcaggtggcccacctgagagatgttcaagtcccaaaagatgcacctgatatccatagaagtgtttctttgcttttcaacaattgacttaatgcaagtgtttgctctgattcctgataacagtagagagctgatcacagtacccacaaggcaaatgtttggtcagtgtttggcccaatgttttcctgctccttctgtgcttgacaaggtggccaacataagataaggtttgcatgactgtcttttagaacatgttctagacagtagtgtaaaagaagacaaaaatatgctgcagagaggtagtaacttgcatgttaaaatattgtttttaaaaaccagttccatgattggtctacaaagggtccaaaacccctgcatatttttattcacagccagaatttccatagctttctggaaataaacagatgcactaatcttttctcctgttctcttacattgagccattatgtcagcccaggagctgaggcttgaggattcactatcctgcctaaaggtaaagattgaaagaggatattatttctgtctggatttctacatttttccttccaacctcagatgaactacttctccactcctaatctcagtctctacatctgtaaaatgagaagaatgatctataccagttttgtgagcctgttcagcactgatacattctgctcccagtataaaattttggaaaatgtctttatctgtctttccaacccctacaaattacctccatgtactctctgcagagttgacttcttaaagccaactccagtatcagaccccttccgcatggcttcagtgagttatttgggtcattccagctttgggaagaattccaataaatcatcagcaaaattccacatgccatgaagggaaagagcaacttcttttcctccttcctggactcagtttttggaagtgactctctccactctgtccatgtgcacccagtaggaatgcatttggatggagagtatcccgggttagcccctcattcatcaccacaccttccctggggctcttgcaccagtgcccttgctggtctccccaaccccaggttcgttcctcctctcctctttgatgaggtaaatgctcccaccagaccaaagttcttattatgcttctaccctgggctatccagcctcccttgcctttccattaatctcttagcacagaaagcccaaggccctgattactacctctggtattgaaggcccccagtaacttggccctgtcctccctggccttaatgtgcattccctacaagcaccctgtgctctagttcagtgtttctcaaagtatggtcctgggactactgtcttcctactgaaaaagaaatgctcagggtgaaacccgaaaatatgcacgttaaatctgctccctgagtaattcttatacatactaaagttggtgaactacttctataaaccacttactctccagttctctgtcaccaacatttaagtctgtgctactctaatctcttgcctgggttgtcagactaaccactaaaatgttttgcctactactaaaattggaaagccactggtctaaagagcaagtgaatagttcaggaacaatctaaagaaaactctcaagggaaagttgaactctagtttgaaagaaaatgataagtatgatgactatccaataccttggaagaagagtgaggaaatggccaagaccctaaagaaaggagtgtttgaaagccacttttttagagaggggagacgggatattagtgactgaaagtcattggcaatatcaaatgttgatagcctgataattatgctgtgaaatctggccagatcagcagaagggaactctggagaaggagccaacttctgagaggtagattgggcttgagaaattgcatgcccctccaattgtaactcagccccatgaaggtaataatggtgtctattcataaatgtacttgcagtgccaacctagaacttggaatatagtaaatgctcaatagttattggttaaattagtgagtaaatgagtgaatgggttcccaaagagaaaatgggaaaggtgtttatgtgttggataaaacaaaatcctttgatcactgatacactatcatattttctttggggttatataacacaaacaaaaagtttatgctttatatagtctctctaaacagctttggcttaaaggattgcaaaattagaaagtaaaagagaaaacagaaatgtgtcatcatgtcactgtagtttgacccccttttctagaaagggaacatacagaagtgtgctagtctgaggaaacttggaagggagattttggacaggagagtgattttagattttcactagcaactacttcaggatgtaactccaaaggagaagacttttttgcatccatgaagtcatgtgactaacagtaatggatgcccactcttttttcttttttttttttttttgagacggagtctcactctttcacccagcctggagtgcagtgccacaatctcagctcactgcaacctctgcctcctgggttcaagcaattctcctgcctcagcctcctgagtagctgggactacaggtacgtgacactacacccggctaattttttgtgtttttagtagagacggggtttcactgtgttagccaggatgatctcagtctcctgacctcatgatctgcccacctcagcctcccaaagtgctgggattacaggctgaaccactgcgcccagcctggatgcccactcttacaggttgacttgtatctctagaaaagacatgttgaagtcctaacccctggtacctcagaatgtaactttagttggaaataaggtttttacagaagtggtcaagttaaaataaggttattatggtgggcccctaatccaatatgcctagtgtccttataaaagagggaaatttagacacaggcacctacagaagggagacaatgtaaacacacagggagaatgccatctacaagccaaggaacctctgaaggtaatagaaggtaggagagaagcctggaacagattccacctcacaactctcagaaggaaccaaccctgccaacaccttgatttctgacttttagcctccagaactgggagatgataaatttctgctgtttaacccacccagattcaatttgcagtactttgttacagcagccctagcaaactaatacacttgctacaggttacaagatacttggaaagagataatgccttaggttgggctatcatagaaacagaagtgagtgggtcaacttaacagaggggctgaaacaagaacacccatcactggaaaatgcacagagctatatgagtagtataaagatggattgtgcaaattcaaaggaagtggagactttatagttattgagggggtggggaaaggctctcagggaggactttctgcaagatgtgtcagtggagctacactctgaggatgaatagaatggggacatgtagagaggtgatagggaagaaggagaagaaccttttcatttctaaaaacctttagtaagagattcctgtaaatagccagctctttattatattaaaaatgtaaaccagccgggtgtggtggctcacgcctgtaatcccagcactttgggaggctgaggtgagtggatcacgaggtcaagagatcgtgaccatcctggctaacatggtgaaaacccatctctactaaaaatacaaaaaattatctgggcgtggtggcatgcgcctatagtccagctactcaggaggctgaggcaggagaatcacttgaacctgggaggtggaggttgcagtgagcaaagattgcaccactgcactccagcctgggcgacagagtgagactctgtctcaaaataaataaataaataaataaaataaaataaaaagtaacctgagattaaaatggcaaaattgttaagtgttaaatctgggtgatggatatatgggaattcattatattattctatttttatacatttttaatggttttttttctttctttctttcttttttttttttttttttcactttaagttccaggatacatgttcagaatgtgcaggtttgttacctagggggatacatgtgccatggtggtttgttacacctatcaacccatcatctacgttttaatcctgttgtgcattaggtatttgtcctaatgctctccctctacttgccccccacccctcgacaggccccggtgtgtgttgctcccctccctgtgtatatgtgttctcattgttcaactcctacttatgagtaagaagatgtggtgtttggctttctgttcctgtgttagtttgctgagaatgagggcttccagcttcatccatgtccctgcagaagacatgatctcattctttttatggctgcatagtattccatgttgaatatgtgcaacattttctttatccagtctatcactgatggacatttgggttggttccaagtcattgctattgtaaatagtgatgcaataaacatacatgtgcatgtgtctttatagtacaatgatttatagtacaatgatttatagtacaatgatttataatcttttgggtatatacccaataatggaattacggggtcaaatggtatttctggtactagatccttgaggaatcgccacactgtcttccacaaagcttgaagtaatttacactcccaacaatagtgtaaaagcattcctatttctccacagcctcgccagcatctattgtttcctgactttttattaatcaccattctgactgatgtgagatggtatctcattgtggttttgatttgcatttctctaatgatcagtgatgatgagcttttcttcatatatttgttggctgcataaatgtcttcttttgagaagtgtctgttcatatcctttgcccactttttgatggggttgtttactcttgtaaatttttttaagttcgttgtagattctggatattagacctttgtcagataagtagatggcaaaattgttctctcattctgtagggttgcctgttcactctggtgatagttttcttttgctctgcagaagctctttagtttaattagatcccatttgtcaattttggcttctgttgccattgctgttggtgttttagtcatgaagtctttgcctatgcttatgtcctgaatggtattgcctaggttttcttctagagtttttatggttttgggttttacatttaagtcttaaatctatcttaatttttgtataaggtgtaaggaaggggtcctgtttcagttttctgcatatggccagccagttttcccagcaccatttattaaatagggaatcctttccccattgcttgtttttgtcaggtttgttgaagatcagctggttgtagatatgtggtgttatttctgaggtctctgttctgttccattggtatagatatagatatagatatatagatatagatatatagatatagatatagatatagatatagatatagatatagatatatagatatagatatagatatagatatatcaggtttggtaccagtaccatgctgttttggttactgtatccttatagtatagtttgaagtcaggtagtgtgctgcctccagctttgttctttttgcttaggattgtcttggctatacgggctattttttggttccatatgaaatttaaagtagttttttctaattctgtgaagaaagtcagtggtagcttgatgggaatgccattgaatctataaattactttaggcagtatggccattttcacaatattgattcttcctatccatgtgcatggaatgattttccatttgtttgggttctgtcttattttcttgagcagtgctttgtagttcttcttgaagaggtccttcacatcccttgtaagttttattcctaggtattttattccctttgtagcaattgtgaatgggagttcattcatgatttggctctctgcttgtccattgttggtgtgtaggaatgcttgtgatttttgcacattggttttgtatcctgagacttggttgaagttgcttatcagcataaagagtttttgggctgagacgatggggttttctgaatatacaatcatgtcatctgcaaacagagacatattgacttcctctcttcctatttgaataccctttatttctttctcttgcctgattgccctggccagaacctccaatactatgttgaataggagtcatgagagagggcatccttttcttgtgctggttatcaaagggaatgcttccagcttttgcacattcagtatgatattggctatgggtttgccataaatagcttttattattttgagatatgttccatcaatgcttagtttattgagagtttttaacatgaagagatgttgaattttattgaaggccttttcttcatctattgagataatcatgtggttttcgtcattggttatgtttatgtgatggattatgtttattgatttgcatatgttgaaccagccttgcatcccagggatgaagccaacttgatcatggtgggtaagctttctgatgtgctgctggattcagtttgccagtattttattgaggattttaacattgatgttcatcagggatattggcctgaagttttcttttttgttgtgtctctgccaggttttggtatcaggatgatgctagcctcataaaatgagttaaagaggagtccgtctttttctattgcttggaatagtttcagaaggaatggtaccagctcctctttgtacctctggtagacttcagctgtgaatccatctggtcctgtgtttttttggttggtaggctattaattactgcctcaatttcagaacttcttgttggtctattcagggatttgacttcttcctggtttagtcttgggagggtgtatgtgtccaggaatttatccatgtcttttagattttctagtttatttgcatatagatgtttatagtattctctgatggtagtttatatttctgtgggatcagtggtgatgtcctctttatcatttttattgtgtctatttgatgcttctctcttttcttattagtctagttagcagtctatctgttttgttagtttttttttcagaaaaccagctcctggattcattgattttttgaagggtttttcatatctctatctccttcagttctgctctgatcttagttatttcttgccttctgctagcttttgaatttgtttgctcttgtttctctacttcttttaattgtgatgttaaggtgttgatttgagatctttccagctttctcatgtggacatttagtgctataaatttccctgttaactctgctttagttgtgtcccagagattctggcacattgtctctttgttctcattggtttcaaagaacttcttgatttctgccttaatttcattatttacctaggagtcattcaggagcaggttgttcagtttccatgtagttgagtggttttgagtgagtttcttaatcctgagctctaatttgattgcactgtggtctgagagactgttatgatatcccttcttttgcatttgctgaggagtgctttacttccaattatgtggttgattttagaataagtgtcatgtgggactgagaaaaatgtatatctggctgatttggggtggaaagttctgtagatgtctattaggtccacttcatccagagttgagttaaagtcctgaatatccttgttaattttctgtctcattgatctgtctaatattgacagtggggtgttaaagtctcctactattattgtgtgggagactaagtctctttgtaggtctctaagaatttgttttatgactctgggtgctcctgtattgggtgcacgtatatttaggatagttagctcttcttgttgtgctgatccatttaccattatgtaatgtacttctttgtccctttgtcttttttgttaatctttgttggtttaaagtctgttttatcagagactaggattgcaaaccctgctttttttttttttttttttttttttgctttccatttgcttggtaaatagtcctcccttcctttattttgagcctatgagtgtcttttcacatgagatgggtctcctgaatacagcacaccaatgggtcttgactctttaaccaatttgccagtctatgtcttttaattggggcatttagcccatttacatttaaggttaatattgttacgtgtgaatttgatcctgtcatcatgatgctagctggttattttgcacattagttgatgcagtttcttcatagtgtcattggtctttatattttggtgtgtttttgcagtggctggtaccggtttttcctttccatatttagtgcttccttcaggagctcttgcaaggcaggcctggtggtgacaaatctctcagcatttgcttatctgtaaaggattttatttttccttctcttttgaagtttagtttggctggatataaaattctgttggcccccatggtcttctggcttggagggtttctgcagagagatcggctgttagtctgatgggcttcgctttttagttgacctgacttttctttctggctgcccttaacattttttccctcatttcaaccttgatgaatctgacaattatgtgtcttggggttggtcttcttgtggagtatcttagtggtattctctgtgtttcctgaatttgaatgttggcctgtcttgctacattgaggatgttctggataatatcctgaagtgtgttttccaacttggttccattctccccatcactttcaggtacaccaatcaatcgtaggtttggtcttttcacttagtcccatatttcttgtaggctttgttcattcctttttattctttttcctctgatcttgcctgcatgccttatttcagcaaggtggtcttcaatctctgatatcgtttcttccatttgatcgatttggctattgatacttgtgaatgcttcacaaagttctcatgttgtgtttttcagctccatcaggtcatttgtgttcctctctgaactggttattctagaaagcagttccagtaacctgttatctaggttcttagcttccttgcattggcttagaacgtgctcctttagctcagaggagtttattgcccaccttctgaagcttaattctgtcaatttgtcaatctcattcttggtccagttttgcgcccttgctggagaggtgttgtgatcatttggaggagaagaggcattctggcttttggaattttcagcgtttttgcacagattttttcctcatctttgtgtatttatctacctttgatctttgaggctgattacctttggatagggtttttgcgtgggggtcttttttgttgatgttgttgttgctttctgtttgttagtttttcttctaatcgtcaggtcccccttctgcccatctgctgcagtttgctggaggtccactctagaccctgtttgcctgggtatcaccagtggaggctgcagaacggcaaagattgctgcctgctcctttctctggaagctttgtcccagaaggcagtagcctgatgacagccagagctctcctgtatgaggtgtctgtcgacccctgtttggaggtctctcccagtcaggaggcatggggtttaggggcccacttgagcaggcagttggtccctttgcagagctgatgtgctgtgctgggagaatcacccttgtcaggatcagctgctctcttcagacccagcaggcaggaaagattaagtctgctgaacctgcgcccacagctacccctcccctcaggtgctctgtcccagggagatgagagttttatctgtaagcccctgactggggctgctgcatttccttcagagatgccctgcccagtgagggggaatctagagaagcagtctggccacagccactttgccacactgtggtggattccacccagtccaaacctcccagtctccttagcactgtcacgggaaaactgcctactaaagcctcagtaatggtggatgcctctcctcccaccaagctctaccgtcccaggtcaactccagattgctgtgctggcagtgaggatttcaagccagtggttcttagcttgctgggctccataggagagggagccactgagtgagaccacttggctccctggcttcagccccctttccaggagagtggacagttctcctgtctcactggagttccaggtgccgcaagggtatgaaaaaacccctgcaactagcttggtgcctgcccaaacagccgcccagttttgtgcttgaaacccagggccctggtggtgtaggctcaagagggaatctcctgatctgcagattgcaaaaatccgtgggaaaagcgtagcacccagggtgggtagcactgtcccttaccgcttcccttggctggggagggaggtcccacagctctgtgcacttcttgggtgaagtgagaccaaccctgcttctgtttactctttgtcggttgcacccactgcctaaccagtcccaatgatgtgaacttggtacctcagttggaaatgcagaaatcacctgccttctctgttggttttaatgggagctgcggaccggagctgtttctattcggccatcttggcccctctccattttaaggttttcatatgaaaataaatatgtatgcaggtatgtatttgtatcagtgaccaacattttattaatattcactaatgcagaataatagtttttcaaaccaagcaagttccaatttgaatattaaaagtcaatttttttttcttatagatcaggagtcagtgtggtctcagaggaggaatagcacacatatcagctacttaaattgaaactgttgaggcactgagtccattgggaacttgggggtgtgacagtgcaggcctattggcatcctgtgtcataggctttagactctggtttccactctgttctatgcctggcctctctgggatgtttcttattttcataatggtttcaactttgattgctttttaaccaaatgaccataatatttcattgatcatctttgaagacattgagagagtcacaaaggggaagtttactttaactgggaggcactgatgtttctctgcttacttccatggaatctacattgagtaagcagaacaaggatacataaagacaagagtttgactttgtgacctaaaaattgagttttaagattgagataactggagaagtaagtctaaaataaaaataaatcctgagtctttaaacatttactctgcatttgtttgctagagttatttaacaatggttttatctgcaggaaatgctttctctctcacagtagtggtatgctagtatatttttatagaatatttttattggtaaataatgtgtagcacacaagttacaaatactgataaaatatacaatactctttattataaattccatatggctaattgattctcccagaatactttaattaatttttcctaagctcttgtatccatagctaatgtctggcttcaatttaaccataatttgacaaatataactgcatcccagcctactaactcttttctcaataactttattgtcattaaacctgatatataattatagataaactatatttcacctttgtacacattacattcattttgtatggcaaaaactgaaacatgtttctacttcagcattatgtatggcaaaaattcacttgtttatccatgatagatgtgacttttttgctgagccaaataacagttttcaaattctggaagaatattttcttaatgttttgtgcataaatgtcatggttacagacacaacacatttttatttcacctgaattattgttttcacaatctctttctttaagtctaggcaatgaatcaagtcctgatttatagttttccaattcacatggtgtaaaatattcctgctatgcctgtttttaaactaccaatgtgatgttactgaacataggcttcagaagagatgtatacagcatttcatcacacagatacaacagaagtaaataacgtcaaggtcgtatgtaataagaaagcatactgaaataaatattaatgagtttgaagtattcattccctttgtttttaatataattgatttaattatgagctcataaaatttaatttttaataatgaccatgtttaacaaccagatcacaaaattcctgaaaatttaactgtcagcactcatgagccagtataagctggcacaaatttcttacagtcatataaactccatattcaggaagtcagaattctaggtgagtaacctaacatgtgtcataataaaatctcacaaatatacacaaaaggagacagaagagtataatttacttctatgcatccaccactcagctttgacaatcatcaatattttgacaaacttatgtcatcttcccctctctactttctcttttctgaaatattgtaaaacaaatattttaaagcaaagataatctcctgcatcacactacagcatggagttgccagagtacttgacccatctattgggggctggacagctgtttgagggtttaatagctacaggtgcaggtgctggctgttgagatggatggggatgcatctccatcatggccaaggagaacagtaagagaagatggaagtctacacaagtgactggccccaagtgcaagatgaagtattaggatgtttcagtggtggggagggggagcagaattaaggcatcttgggggaggtgctccttgggaaatctgacaggcaggtttcagtgcttagtaggactcagtccccattttgagaataattttggtcccttggagggaagattggccatcataaggcaaaggccagtctcaggagagagctggaggtactggaagatttagaagaacaggaaccttgtctttaaaaatttagaactacaggtttccatttatgtgcctccaatcaaaatcaaaactgggcttccaaatcagaaacaaagctcaacctgtgtgtagacatcaaatgatggtggctacagagaaaggaggcagattggacctagcatacgacagactggacctagcatacgacagaccactcccaagagatgcagagctgcaaaaaccaatacaagccctaaagcagctgttctcagacttgagcattcagaataatcacatgaggagcacaccagtgcaaattcttaagctatacctcagggactctggttttgtaggtttgaagaggccctggagtctttgccttgagtcagtgaccctggtcattctggagaacagggtcccaggaccattcatagagaaaatttgctctaagtttcaacagaggagagagccttccttccctttgatcacccccctcttattatataattgatttctattcttcccataaggtgactgaaaagtgttatctttaacttgacatgactggtgagaaaatgaatatggtatactttgtaagtgaaaaagctgaaagaaaactaaattttactgagtacatacatatttcatcctagacaatgttcatagtactttacagaaattggtttccaagctaagagcttcttattgtggggacagtatgggtacggtgacagaagcctgcatttgttgagtgcttcctctgtgtcaggacatagccagcgttaattcaatttctccaactcattgagtaggcgctatgattattattatgccagttttacaaataagaaagccttttattggcggtcatacagcaagtaagtggtagagctgggattaagcctagacatttggctccagagatcacatctgaccaccagatgacactgccaagcaccttggttggtggtcagatgtcctcagtttctggttgccatctcccctctcccagagctagtttggtcagtaacaacagctctccatagagtggctcctacatgcagggctcttgtacagactaatccttttattgtggtaaaatatacatcacataaaatttaccaactgtaactatttataagcatagttcagtggcattaagcacttcacactgttatacaaccatcaccaccatccatctccagagctttttcatcttctcaaactgaaactctgtacccgccatcccaactaattttgactcctggctatgatggatcactctccagttgctttcaaccctatctctgcagcatagatacagtgggagtccccttccagtcctaaattcttcctcatttggggaaaatgtgcggcttgctcaaataatgttcccctttcatgcttctcttgcttttcatcgtcacaatgctgctttctccctccctaattcaccttcacaattgtataccttgaaacccacatctcacaggtcctagaaaatgcaaactgcgtgagaaatccagcttcccccttctggctctgctccctgcttccccttgtgaagagcccccggccctcttggcctcccccacaatacaccgtccgctttgtattcagccttgtcttacactgaagagacatctcttttctcttctcccagggccccagcggctacctctctggcctcctgcattcttagcccacttgttgtacatattcctacgctaagttgtgatttgtgtttgtgtcatttgaatgagtccttggaggctgtctttgaactctctgcactcccctccccctccccctccctctgctccagctctttcgctgggggcgacctcccacctcccgtattctgattctatccaggctgggtctgctgagctcattctcttggctcttttcccttcactggaccctggacaccctcctcccaatctctgccaccccctccacccaaccctttcctcctcagtggattcttgcaaaatgctctcttcttgaccagggaaagttcctgccttcttgtccactgtcttcagcccagtgcacttccaaacacctctctgtcctccctaacccattttctggttgagttatttttctacccgactgaaacttaaaattcagcctctttgtttgccttcccttggttcctccttcctttctccttctcttacagactaagagatatctgagccactggttctttcttttctcctttccctctgctcctacctctctcccaagacaaagttaatacccaatgtcctttgccagtagcactgctgggccaccaaaccccttgtcctgccagtgatttcttgtgctacgcccatgtcctatctttggccctccctaaagcctgcagtggaaacaatttccaaaccaaaatcagaacaatgacagatttttttttgacttgggctttgccattatgaaacatcccctaaagaaagtgatagagactacatctcactgagttttgctcataatgtgttccatgtgtacgtcccaggaaatgtactccaaagaagcagtgttcctctccccagattcaactcttgcctgaccctagctggagaagccctgcttgtccttcagctctttggatcatgcttatacgcttaggccagctcccagagttgtctgatttttgtcctatgactgcgaatacgtctacaatagctcccctgatcaggtcagtgtttcgttcctgcagagaatgaacagagtccctggccatggcctgccaagtggaatcatcctgccaccgccctggccccttttctcctgatacagtctccaccacaaatcaaatttatctgctcaatctgaagctcccatcaaacctcttacttgccaggacgtgaattactgttaatcggtctcgtgagtcagttacaatcaaattaataagcaggatccccaccggattgtctccaactgagcggctgctctcatcctccaaatgaatcttcccctgcaggggtctccagcttgtttcactcatcctgaggaaactgaaaagttgcttctcacttccacttgtcctttcctcctctcaattaacctgactcaaaacactgcaggtacagaaatattacactgcttttctttctcacttcttccttgcagttctccacatttacctccctccatcccttccatctaccccagttctggagtttctccttggtatccctgttctaaagggttctcacgtgcagctggctccaaagcaggtagatattgtactcgagtttccttcccatctgttatttatgcctaccctgggctccctctgtcctcatctgggcctggcagcctaaactgctacttcttcagagatatcacactccttgtaaaggtggccatattgtctccttcccagcattcaccatttactcacaagtgacacttgttctaaccttttgaagcccttttaggtaaacaagacaggatcaggtagcatctcaattttgcatgtgggaaaggtgaagcccagagagatttcatgattggccctaggtcccttggtgagttgctattaggggcaagattatgacttaagcatcctggctcttaggtgggtattctgtctagtagatgctgccacaatccattatccaaataatctctgacttagaccaaccatctgtgaataatcttcatttcccagaccattatctgccactgagaaattgaggatctggttacatttaagagtctctaaatgacttgagctcccacccagagtttctgagcctttaataacagacctactgaggataattttgtattaactaagcaccctatccatgttatcttcccctttgacagctcagttctatgagaagaagaggggatttaggcacgaccatcccccaactcttcactcttatcattccttctacttcttacccctccaacaactttgttggtttctcacagttcctttatcaaagattatttatcttctgctcaaaatgtcttcccttcttctctctccttctcatccctcatggccccagccctgtcattaattcactgtataaccctgaggtaatcattccttctccctatccctgatctgcatatcagatgcctggttaataaaataatgtcatctattttatcttgatgggtgcaaacactatagtggaggcttgatgaacaacaaaccgagaaggacttagagagaggaacccaaattttagcaaataacacacaataagacctgatttaaggagtgacatacttggtttctggagagaaagacaacatcacaaggatgtaaatattttgcaaattattataaaaatgtgatttcagtcaaagtatcaatggtgatttatttcaaactttacaaattgattctgaatttcttcttaatgtaattataaataagatatatttgaaaaagaagaataataagagaggacatatgtactaaagtctcattaatgaaaacaatgtggaaccagcacagaaagagtttagtcaatcaatggaatagaataagcattttagaaacaaacacatgtctgtctgtgaacgtactacttaataaggttggtatttcaattcagcgggaaaagtaagtattattcaacaaataaaatgcaggggttattcactatctatatggaagaaaatgtatacagagacctacttcactcattatgcaaaaataaataaataaatcaggtgactcaaagatctaaatgtaaaaactctggagttttcggaaaagatacaaaagaattattaccctgagataaaatgcctgaactcagaagccataaagtgaaatattgacagtatgactacataaaagatttaaagctatatggtaaccatctcacattaattaagggattagttactagaatacataaggagctcaaaccactcattaaggaaaaaataatctgactaaaaatgggcaaaagatctgaatatacatttctcaaaagaagacatacaaatggccaacaggcatgtgaaaaatgctcaacatcattaatcatcaggaaaacgcaaatcaaaaccacaacgagatatcatctcaccccagttaaaacggcttttatccaaaagacagttagaatggctattatcaaaaagacaaaaaaatgctggcgaggatgtggagaaagaggaaccctcatacactgctgatgggtaagtaaattagtaaaactcctatggagaacagtatggaggttcctcaaaggattagaaatacaactgctgtataatccattaatcccactgctgggtatatatccaaaagaaaggaaatcagtagatcaaacagatatcaacatcccgtgtttattgcagcactttcataatagccaagatatggaatcaacctaagtatccatcaacaggtgaatgaataaagaaaatgtggtacatatacacaatggaatattattcagccataaaaatggatgaaattctgtcatttgcaggaacatgggtggaactggaggatattgtgctaagtgaaacaagacagtcacagaaagacaaactttgcatgttttcactcatacctgggagctaaaaaacataaaaagaattgaactcatggagatggagagtggaataatgattgtcaaaggttgtgaagggtgtggggaggaggagataaatggagatggttagtgggtataaaaatacagttagatagaaggaataacatctagtatttggtagcacaataggatgactatggttaaaaataatatattttatattttaaagtaactagaaaagtggaattggaatgttcctaaaacaaagaaataataaatgcttgaggtgatggataccccaattaccctgattagatcattatacattgtaagcttgtatcaaaacatcacatgtaccacataaatatatacaactactacgtatccataattaaaaatttttttaaatgttaaatttttaaaactgaaactatatggtaagctacatataaacaaagttaaaggacaagcaaagaactgggaaaaatatctgtgacatgtctaaaaaaggattaataatttttctacacaaaaatttctgcaaataaccaatcaaaaaatggatgaagcatactataccgagattctttaaaaaataataaaaatcggcaaaaaatatgaaaatatgttcacttccactagaaaataacataaaacttaaaataatgcaccactttcccagattaagaagaatttaaaatctagataatatcaagtactggtaggtgtgaaagggaatggatattcatggactgttaaacagaatatatacatatgtccacacacacacagacacacacgcatgtatatatatacatatgaagctaggtagtgtctaatatgtgtgtatatctatatgcccctgtgacaatgaactttcatttccaggaatctataatccattttataaaagtattatcacaaatatttataaaggtatatgtgtgatatatatgaggatgtttgttttagcctttttatttctcctgtgattcgagtggcccagagatgggcatagcctgcctcccaggatgacaagggctactctactcctccatgctggctgctaggagcagtggagctccagacagccaaagcttgaggggactcagttttgtttttaatggtagaaaaggagaggtggacaacctaagggtctatcaatttactatactatacccacacagtggaatactaggcagccattaaaaagccaggagtagatttatatatcctgtaaagacacccagataacttgttaagtgaaagaataaattattgtctcatatgtctaacattgcaactttattttttaaaaagaacatatttatgtctatttatatataaacatggatttataagcataggacaatgtcaagagatctatgcaccaaaatgcttcagaagtaacccctactcctctgggggtgattggagaaactaaagggggtactttcattttttactttatattattttcccaaaagatgatagaataaagataatatttatactttttccgtgcgagttttaaaaatgcaaacaaaatcataaagtggtcaaaagaatggttatcactataagtccaataatttcattcgtttattgaaccaacaattaagcacctacttgggcatctggcactatgcaagatgctgacggtaagtgactaagggactaagccagggtgcctactattaagaaaattaaatccacacacctgtatgagaaagaaataagcagacagtgacaaccctactgggagtatgttgacaccagtaaccaaaacagaaaagacagagacagatttggaagactggaggtgatgacgagtctggttttggatatctggacttgagagttgcctgtgggacctccaggtggaactatccaacagactgatagatgcctctggagtttgaagggagagatttgggctacaggtaggaatcttagagaaccttgccagatgtaatatgaaactcatgtgagttggcaagatcacttaggaagagtgtgaacagtgagaagagccccacctgggaacccaatcttgaaagtgcaggtggagaaaaagggaccagacctgcccaacatggagagctgcagcatattctccaaacttcataacagagctattgttagtgacttgagagctggtccaggggcagaatccaaattgtgatccattaggagtggaaaagagctgagtgagtggagactgtgtttgtgcactacctttgtgaaaagcttggaagggaattgaaggaaaggtatctcagacaggtagttagaagaagatgaagtgtcaagggagaggtgttttttttttttttagattcaactacccagaagagagagtaaccttgatttctacttcatatcttgtttgttttcactttatatagtgtaacacaagcagcaatatcaccaacagtcttttaaatattattttaaaatgtgtagcattcatataatgatagcacaagtatgtaactaataatatgattaactaatatatttaactaaatagttcttggtgggcatttaggttatttccaatttgagctaattatgagtaacacctatatacataaatctttgaacatatctctgaagcagttcaaggtgtgtgccaataagtagaatttctgggccaaagtctaagaaccattttaaggctcttgatgcaaattaccaattgccttctagcgggtaggtgaatgtcctcctctgcacacctctgccacaattgggcattagtgcttaaagaaaaactgtccatttaataaacagtaattagggtactgttaagttagtggtttttagcattaataaggatttcatgctcattggccatttgcatttcttcatcatgaattatctgctcatgtcctttgtccacatttctattgagtgatttcatctttttcttatcgacttgtcagaatccttgctatatatgtattgtaaatattgttcggagtctgtcatttgccttttaattttagttatgatgactttcttgacttgcagttctttttgtaatcaaattctaatcaatttgtttaggggcatcctgtgaggtctacttttattaataactttttacaccaaatagctatccaattatctcagtaccttttatgggataaataattatttttccaggtcagaaacaacacctttcatgcatgataaatttttatatactggggcctgtttctagattttttattttgttccattaatctacatctatttttgacagtgataccgtacagttttattttttatttttatttatttatttacttgagatggagtttcactcttgttgcccaggctggagtgcaatggcaccatctcggctcaccgcaacctccgcctcccaggttcaagcaattctcctgcctcggcctcctgagtagctgggattacaggcatgcgccaccacacctggctaattttttttttttttttttttttttggagatggagtctctgttccccaggctggagtgcagtggcgcaatctcagctcactgcaagctccgtctcccagattcacgccattctcctgcctcagcctcccgagtatctgggactacaggcgcccgccaccacgcttgactaatttttttgtatttttagtagagacggggtttcaccgtgttagccaggatggtcttgacctcctgacctcgtgattcactcgccttggcctcccaaagtgctgggattacaggcttgagccaccacgcccagccttaaattttgtatttttttagtagaaacagggtttctccatgttggtcaggctggtctcgaactcccaacctcaggtgacctgcccccctaggcctttgaatgtctgatagcacaaggtagtagagggagggagagaagacaagaaaaaggaaatcctcatcctaggcacatctcagtggacctcagaatggcccagtgatccagcaatatcaaccccactactttgaactacacagagttatgtttgttgtttgttattcttgtttggtttggtgctttgctttggttgggtttggtttgattcagtgaacttcctggtaggacttaaaggcaaagatctatgctcactcagtttctgaatatcagctctgcaaggagccctgtgcaaggagcaacaaggtatactcagtttggatgcactcccccagtccctaagggaaaggaggagtgacttgtggaaaggagtagtgactcttcctgcatgagcaagaattaaccacaacaatcattgagttttactgtattaggaaaaggagggaggtaatctcttgacacagactgacacacttgctcacgtccaacattcaccaaatgacatgttcaagaaggcaccagtggggctttcaaggattttagattaaagaagcctaaattgggttttgtaaaactcagagaaaatttcacttcccacaaattcaaatcagggcactcctcttctcaatatgccaaatctacatcaggcttcccaggctccccatcattattagtttataaagattcattgatattcaattaagtagttctaatgttctcaatgcagccctagacagcactttataaagaatacatccgccctctggagacagctggggaagccaattagtcggagtaaatttacatatcaatccagctgtggaatgaagtcggccttgttcaccagtcacaatgtgaagagcaaagggaggaatcctagcgctcccttgtcttttattccctcaactcaagtgagctacagctctcattaaaagtctgtgaatactgggagagagaacctataaatgctcccattccctgccaagtatgcactatcacttagaagcaattattaatggggaatgtttaatgctctcccaaaggttagtactaattcacataaatattgtatcacctaagaaatgatttttgttcaaggagttgaaaaattgggaactaattctattgtcaagttaaacttcaatatagcgaggttccattttttctaatgatttcattagatagcaaggatccaactcaattcaaaaaacatttaatgaatcactaccatgctaaggtcctgtgcaaagaatgtgaggaaggactttggtaaggtacaaatagcaacgtttaatgatggcaaattgatagactatagagttagctgagtccttaagccactgagccaaaccctagatactttcagaagttctgccactagaatcctcccaaggcagcctttctgatctccaagtcaatttattatgtctcccctaatggctccattcccaggctaaactgcagctcttccacatttgacagagctctgctagccctctacactagcatcagctctccgctgaacatgttgctgctggtctctccttgaaacattgcaaattagaagagattggaacaacatccttaatgtgctgaaagaaaaatatctatttagaagcctatatagccagcaaaagtatttttcgtacattaaggtgaaataaatacattttctgactaaaaaaaagaagaagaactaaaagaatttgtcatcaggagacgtgcatatgggcaagataaaactctggggattcacagacatgttcagtatcttgattgtggcagtggtttcatggatggatacacatgtttatccacatatatatctcagactcattggaatagcacaatttgaatatgtacagattattatacataagttatacctttaaaagtattataaaaagatgactggctgtctaaagcaaaatagcaatgatgtattatggagtttgtaagacataaataactaaaacatacgatgatagtacaaaggacaagggaatggaagtacactgttataagattttaaccaccaatgtgagttgtaagaaaatgatttattgcatgttgtgataagctagagactcataagttaaacctcattgcaaacatggaacaaagaagtgtgccaaataagccaaaagtggaagtaaaatgaaacaataaaattaatccaacttaatacaaaataagtcaggacaagagggaaaagggaacaaagaacagacgggacaaatagaaaaaaaatggataacaagaggttacacttaaatgcagccatgttaaaaattatattaaatataatcatctaaacactgaaatcaaaattcagagataataagactaggtaaaaaggcaagatcactcagtatgttgtcttcaataaatgaattttaaattcaatgacacacttaggctaaaagtaatcagaagaaaaaagctatactatgcaaatattaatcataataaagttggacagatgatattactatcagataaaatgaacattgaggaaaacaaaggaagtagttaatatcctcactttagggatgagatagctgaggtccagaggaaatgaaatgcatttttcaatatcatattactagaaacttggaaacatgtagcctggaggttcttgttaggaaatttcaggttagatgcatggtggtagtagaaaaggcttgaaaactgtggggctgcctaggggcaaatatttcaagtataataaacaataccttttgagcatcacaagatcattaaagggtcagatctgaccctttggcttactgatagccgagttgttctcttcatatcatatacaattttactgacaaattgtccacatataatatttattatatttgatttgggtttttccctaataatttattaacagcctggttgacttgagatttatgaaaaaataaatttgtttaatgaaacagtgatcagctatggtaatgctgatcattatgcttttatacaatggttcatcttaggcacagaagaaagaaaggcagtagcccctgtcaactgtgctttgttaatgccagagcaggacctaagccaagtactttcctagcattatctcatttaactttatgaacaaacctattatccacattttgtacacgaacctgaaagagcatttcactgatgtcttgaaaaccaaagcaaagagagttacaagaagggaattttttttttcacttaaactttctgttttttttcttcttgcatcaacattattgagttataatttacatgcaataaaatggaccacccctttttgactgtatagtttgacaaagttttacaaaagtgtacgctcatgaccactgccacaattaatacatacattttcataactctcaagtgttccctcatgttccatttcagtccatctgcccatacccatttcccaaggcaacactgaaatattgacaaccgtgtactgtttccccaatattttgaaaaatatgacacatttcatctaatctaaaatgccattgattttgagatgcatcccagttttgaggatgttacaacaggaaaaaaagagtatcttcaaatctatgaaattgtatgcctccttttatatctataaaatgctttgcaaatgcgagcaactattattaggagctaataatggtcctggttttattaaccaaagagacatggtaacttttagttagttgttgcacacctctcatattgctcaggaggaaaactgaggctataaggaggaaaggacttctctatggctccaatggaaagggaaggcatctgccaccctagaagactcccttctattacagtcttgccccaaatgggttaagagaggacttaggccagggagggcttactacacagtctgggtggtaggagattaaagttttcaaaggtcaagataatgttccttcccaccaatcccatcccaagatattttcagtcattgcaatagctacattcattatctcagattcatgattacatgaacacaatagccagatcagaatcatgacaggctcagaagcctatggtaaatggaatttgaatactaaatctaaagaatattgttcatcttgggtttgaattaagaacaaagagaaatggaagtcaagatgaaaatacctgtaattctatctttaatttatttgacatttcacttttttgctcaattatgtgttttgttttgttgctaactagttaggcttttgctagttcatctcaacagatgcccactccacgttcagagaaaatttaggtaaatgtagggccgggcgcggtggctcacgcctgtaatgccagcactttgggagtccgaggcgggtggatcacgaggccaggagatcaagatcatcccggctaacacggtgaaaccccgtctctactaaaaatacaaaaatgttagccaggtgtggtggcgggtgcctgtagtcgcagctactcgggaggctgaggcaggagaatggcgtgaacccgggaagtggagcttgcagtgagccgagatcgcgccactgcactccagcctgggcgacagagtgagactccgtctaaaaaaaaaaaaagaaaagaaaagaaaagaaaagaaaatttaggtaaatggtaaaactttttttacatcctttgtaattctgtgaccactgaaagagtgacaagtttcataaaacaaagctggaaaaatcaattacaaattaggaaactcagtcacacatgagtttgagaacacccttcagagaacttccaggagggaaagcagatctcttttattccaagggcatcaaagtttggaagccagcaagagttccttgtaaagtctgctgaccaaaggtccagagcaaggtttctcaaatggaggtgggggatgattttgtccccaaggggatatctggcaatgtctggagacatacttggttgttacaacttgggagatgtgctactggcctcgaagtaggtagaggccagggacactattaaacatccttcaattcatggggcagctgccaccacataaaaaatgtatctggcccaaaacatcaatagtgccaaggtcaagaaaccctgtcccagagagacaatcatttattcagcaagtatttagtgtaagcaacttactgtgaatcccagtttgttactgactaacagagtatactgggcaactctctaagcccaatttttcacatctgaaaggtgagggagacaataatcacagctatgttacagggtgagtgttcagtaagtggtggctgctctcttgcctctgagctatgctgcttactaggtccatgactttgggcaagttatttaaactttctgagactctatttctttatttgtaaaacagagctgtataaagtactgtgggggctcataagagacttgaaaataggtttctgccattatgagatgaagtgggaaagtgccaagatgagagaaattacccttgtggggactgcaggcttggcggaaggtgaagttcttctctagctttgatttcactcccacccccttctggctttctccattctgcagtggtctggtggtagatgagtgtgccgaggagcagatatgccaatgttcttgcggttgagatgtcacatcaaacaggaacttacgagaaggccatgaaaagtcacttgtacctacaaatatctgtctaaaataggagactgcttcctgaaaggataactgatcctaaagcactgcatgggatcaaggtgacaaccaattctaattaacaaatattatgatatctctattatgtactacccacaaggctaatcagtgaagatgtaaagggaaatagaaggaaagggaataagagggaattcatattgagcccctagtctgtcccagatgccgggagaggggctatggtacccattttctcttcacaatatcctattatatttgtcaggcttctccagagaaacagaaccaataggatcgagagagagagagagagagagagagaaagagagagagagtgtttgtgtgtgtgtgtgtgtgtgtgtgtgtgtgtgtgtatgtgtatatatatatatatagagagagagagagagagattataaggaattgattcacatgattcctagctgagaattcccaaaatctgcagtcagcaagctggaaacccaggagagctgttgtatagtaccagtcccaaggccaacagacttcacacccaagaagagtcagtgtttcagtccgagtctgaaggccagaaaagaccaatgtcccatttcggcagtcaggcagaaagagctccctctcgctcagcctttttgttctattcaggcctccaactgattagatgaggtccacccatattagggaggacaacttgctttactcagtctgtcaagtcatatggtttttaaaaattgacaaataataattgtacatattcatggggtacagtgatatctcaatacatataatgtatagtgatcagatcagggtaattttgtatcctttaacaaatctctgtatatctctcccttccccttccccttcccagcctccatttgttgggtgtagtgacatggacctgtagtcccagctactcaggaggctgagtcaggaggattgcttgagtcaggagttctggtccaatctgggcaacatagcaagactcccacctgtttaaaaaatacatacagattaaaaacactctcatagacatacccagaaataatatttgcccagaccaaatgtctgggcacccccaccctactccatggccaagtcaaggtgacacataatattaaccagcataatattcctatgaagtaggaattattgtgtgtatcactatactcaatttacaggtaaagaaaagggacttagtgaaataagtccctgccaaattcatacagttgcaaaatcaaaacataaaactaattctgtcttactccagagtcactctgaagtaagacatgcccgtcccagtcattctctccactctcaaaccattataatctacaaatgtgacgctgagcaagttcttttcctctctaggcttcagtttccacatgtggaaaatgatggttttgaactagattatctcagaggttccctctagctctcaccttctctgactttacttaaattgagtttttttaaatctctggtattggtattctttcaacacattgtccagaagtcattttgacagaaaccctccttctgacttgacagtatggttaatttgcaagtgaaaagtgctttctacaaggtgaaatagaaaactgggaaagttgtcaattagctaatagcaatggggataagcatgtgagcctgtgagtgtgcatgcatgagtgtatatgtggtgggtggagataaatcttaatggtaaaactagacaaattatttcttctaaccctctaccaaaaatctattagcttatgatgttttgtccacagctttttaagtcaatagaaatgaatatcttctcctacatctgattgtaccatcatggaggcaaaccagataaattactgtcaatatctggccaattaacttactcaacagagagctaataagcacatactatatgccaggtacttctctaggtactcagggaataaaagatcaatatgagatactcttctgttctcaaggagcctgtggtgtactaacatacttggggatgggaattgaaagtgaatcaaacattctcttgtgcaggatcccagctaacccatcctggcatccagtactttagagctttcaaagcactttcacatccaccatctcactttgatgctctcaggagccctgtgaggtaggtggggaagatttcatgaacttctttttatagatgaggaaactgaagccttattagaaattaagtgactcaggtgctggttagcgagtggcaaaaccagaacctacattattgggttatgttgactcaagagtcaaatgctcttttccccagttgtcttcatatctctaggccctggctgccatcaaacgtttggtggccgggcaaaggagtttcctggaaatatatctcctggaaaacattccatttagaaggacaattcaggtggataattcagtctctaatttttacaaaggaaaaagttcctttcacttcagtataaactccaagaaaacctaatgaagatgtcagcacaggcaaccatgttgggagaagttcccacattgactttgtgcgctttaaacttgcatgctgttttggttttttgcccatgcaggtcagtgtcaaaatactggcgagactggaccacaagtggtatggcagtgctatttcctgttccagaggtagtgctttttcaatgcatcctggatgcttgacattgtattccactctattgtattcccctgatctcttcactccttgtgagttctacctgtgtccgtggtgacctgggcatccatggcttcttgctgcctccttctagctgggtagccatgttgcttcacacactgggatacagtttcttcatctgtaaaatgggaaaatagtattagaatataggaagtataacctatcagtgtacatgagcatgggattgggagacactaacacatttaggaatgaggaaagggcctaaaaaatttattcttggttcctcaaataaggtattagctgttttgtctaggcaagtgacttcacctctctcaatcccagtttcctcatctgtaaaatggtatcgtggaactaaagtctctctaagacccactcaacactgggattccatgactcagcaagtggaaatgaacacatgacttctaactgtccactcctagagtggaaggcactgaaaacagaggggaaaaagaggagggtgaaaaatacggggcaagaaagcacaggaagagcatgttttattttttttttctctttcttgggagaaagaatagactgaaaacacagaagtccatttaattaaactaaaataaatggattctcaaaagaaaaacgttaaatgtggttcaatcaaaagataaggtctgtcagcactggtactgtcagagaacatcagctgagctcccggatccctggatagagaattaggagggcactaagtgaaaccacaataatcaagttgctattgtgggactgggttcaaagagccagagtgctgaggagaagacgcttacatcatcatgtccatctgcacaagcaagtcatttctgctccttggagactccaagtagcaaaatcagttaaacttgcttagtatccatgcaataaaataggttgtggaagacggagcttggaatagtcatggccccaagaagattatatgagttgatccatatcagattatttaaagctcagttacatcatttaaaatagtgaaaaattgaaacctatccagaggtctattaatggggagattactatataacctatggtacgccactgggatggtggagtagggtggatgggacagactgaccctgacctgcctgaagcacagagctccagttaggtactttcttcattttctatatattatgatttcacattctagaaaatctttctggctgtggagagacagcccctcctggagctagccaattcttagagataacaaatggctcaaccaggaaactgcctttgatatgcaagctaaccaaaccagagccaggagccctgcctcttctatctggcccatacgtcacaggacgcaatatccctcggccttaatcatctcagggccaggtaccaggcaactaggccccatccctatagcttagagcctgtcagaattatacaaattagaaaatcctaagccaatcacctgttctgctttccctttcccaaggaaaccccaatgatagccatggcctaaacactcacctcattcctgtgtttgcctccagatgaccctggtgtcatgtgggaaagcacttcccacatggtcctgtgtggtgtggtgtgcctcctgcctctgggacctgggaagataatcaactttgtttcttcctgagcctctcctggctgcatttgactgaccatgtcactaaaaaaatacaaaatggtaggtgagggccagtgtggcttgtgggatggactgtagcccaacacgacttgttattaactgccccatatctatccatcctctaccctccccacatacatgccccacagctaagtcctgtcctgttttctctgtttatcttagtgatatcccaattgccccaattcccccaagctcctaagttaggaacttagtcatcatgtcccctttctctgtctctcactctccgtgtccagtcatttgtcagttgcttcctttaaaatctcttttgaatttgtttcttcctttctatttgatagctctttatcatttaaactgatcattgcgatcgacctcccaactactcatcctgcctccagttctcctttcttttcaattcagcccatatacccattttaaatgaaccttcttaaaatactacattccccaaatcccttctctgctcaaaactgtccagtgcttgcctttgtcctctggatgaattcctgactctttagcctgtatttcagggccttccatgagctgatctttgtctaacctcagcccccaatgtacacctatgttttgaaaacaggggaagcacaacttatgagaagggaggccctgactagagatagtgtatggtttgaaccattaccagctgaagtgtccagtgttcttacacatggcattttcccactcaccttcagaagtgagaaggaaatccgaataacaccgcacactagtgctgggctctacagcttatgatgtcatttgcatatgccatcacattgtgagttgcaacagtcagtaggcattattatcttcatttcagagatgagcagcctgaggcccaaaaaaggacagtgacttgctcaaagtcacacaactaagaaatgatggagccagtaccctcttttcaatgatttcggccaatatcctttattcccttgcttcactgtccacactctacttcatctcatccccaaaacggccacacctggactgacttcactgttgcctttctcactccttacagcagcatcatggagtgctcctagaaaaactcacctggccatgcaggtcctcccactaaagatttgacccatttgctcccaggcaccttctcaagacccccatctatcaattatggtctcattctcttgtctggctttgtctccttagcaacaaaacctgctaaccagcccacatgttccacaaaaaaaaacacacaaaaaaaacccttttctgaatcctgtatctcactctaggtactgtcatatctctttcttttctcaacaaagtttattgagaaaaatcattactggtcattgcctcctttccctcactttccgttcatggtttagtccattgcaattttgggtacaacctccacacttatctctgaaactgttcttaaggccaaattcaatgagcacatgtcaattatcatcttatcggccctgacagaaatgtttagtcaggttaaccttcaatcttgaaagtctctctttggcctttgcttcctgaactcaactcttgcctcattttccatcttcttctcttgtggtttctttttagtctcttgctcagacttgtcctctgtctactccaacaaaatatgtagctatccagctgtgaagcagccttgagcggtagagttccccgtcactaggagagttgagtcagaggctacataagtatctatacagagacatcatagaagaaattcctacaccaggtgttaacttcaattaaatgaactttaaagttctttccaacccttaaattgtataagtctacatacgctgagtgccaagtaagaggtctggtgaaagaaatgctatcagaattaaaagtgggggaaaaatttttaaaaagtaagttaccccatttaaatttgtttgaataacactatggccataaaagatcacccagtaataggacaatggctgctattcatttttctaaccaaggacttatttgtctttgatgttgagatatcactactcgaatctgggcctacctgaagggtaagagggcagaaacggagagaatcctccactctttaacctgtaacctcattctcaagtctttccgacactcaggtctttctcatcacctccaccaccacacaaaatctttcatggattaaaaaatctgtaatctatgaaagaattacaagtgccctctagagctttggtgcccatctctggaaaactgctgtagcttaagtttttatctcgtatctttcaagaatagatttatctttggtgtcagactgcttttctgatgttattcagagatttggatagaatttatattcagaatttgggtcatattcatgctgcagttaccttcacagtggaattgccctttaaaatttttaatcatatttctagaattaaaattacaagttgattttacatccctgaattctgaactctggcaccttgagctggtaaggctatcattttctaacattattttcagtagtcatagctgtggggtttgcaggtcatcctcttactataaagcaacaaaatcacagtcttacggctggaagttttagagtaaattatcatctgtattctggctgctcttagagacatttcagtgtctttaagtaattgtctttgggtgtatcatccaggttctattattgctatctgtgggagggtttacatgactacttcacttgtttgacattaccatccctaggtcatttagggccgacgaaacagagacctacggggctctcaattaaaaacataggagtggggagaggcgctgccgccacggcggccaagcgagcgcagtcggggcgggcggcgggaagaagcggcgggcccgagctgggaggcagcagggagagcccacccaccaccttcccttccctcctcgatgtgagcgggggcgtcccggactccgcagctgccagaggagggagagccggggccgtcgcttccgagttggggctgagcagccctcggcgagagcgcgccaagaccgccgcagctgctagctgagttaaacccacccacagtcatggccgaggccttacccaggaccctgggggagttgcagctgtatacaatattacaaaaagccaatctgctttcttattttgatgcctttatccaacaaggtggtgatgatgtccagcaactctgtgaagcaggaaaagaggagtttttggaaatcatggcactcgtgggcatggctagcaagccgcttcatgttagaaggctacagaaggctttaagagactgggtcacaaaccctgggcttttcaatcggccgctgacttcccttcctgtcagtaacataccgatctataaattaccagagggatcactgacatagctggaaatatcctgcagtagttatgaaaggagtagcaatgcctgggaacctcattttaaaatccccaattttaccacccaacttttttaccacccaatttaccacccaatttccccaattttgccaccacctgtgtgcagagcttgggacaggggaagtcagatgtggtcgggagcctagcactgcagagtgctggtgagtccagactctggcaaggccaccatgccaccaagagcgagcacagcctctccccagcagacctgggctcccacacgtccccaaaggagagcagcgaggcactggatgctgctgctgtgctctctgtggcagagtgtgtggagcggatggcccccacactgccgaaaagtgacttgaacgaagtgaaaaagctgctaaaaaccaacaagacgttggccaaaatgcttggtcacatctttgagatgaacgataatgatccacgcaaagaggaggaaatttggaaatacagtgaatatatggcagatttgactcaaagaggaaggatggaaaacatctcatgcttcatgagctcactgttaatgaagcggctgctcaactctgtgtgaaggataatgctctttgccttggctaggcaggtttctcgagaagtcacctataaatatacttacagaaccaccaagtcaaaatgtgaagaaagagatgaattatccttgtagaggattaaagtggaggatgggtttccagatttccaggattctgtgcaaacgctcttccagctggctagagctaagagtgaagaactcgcagcccttagttcacagcagcccgaaaaggtgatggcaaagcagatggagttcctctgcaaccaagctggctgtgagagactgcagcatgccgagaggaggctgtctgcagggctttacagggagagctcagaagagcacagtcctaaaggcttgacttccgataactcagatggacaaggagaaacacctttgaatctccgaatgcctaatttacagaacagacaaccccatcatattgtggtggatggggagctgagcagactttatcccagtgaggcaaagtcccactcatcagagagccttgggattttaaaagaccagcctcactcagcttttaccttagaaaagaaagtcatcaaaacagaccctgaagattcaagatagctgtgattctctcaccgttctctggaaatggcatcagatttaaggataatactccatcatataaataagccttaataaccagtgttgcctcattcagctcaaacagatttcatagccaaagcaaaaggactgttacagtagcctgcagaaaccaggaagataaaacaacagccacaaaagagaaaatcaaaagagtgttgcaatctataacagtaacattgattcattcacattcctgtgttgagtcattctatatggaaaggcttacaaatcaatattgtaagcattcattatttaagaatgtacaatgcatttgtgtaatttatagaagtaaaatctagatgttcagacctgtttggttcaatagatgtggatacagcttattttacttgaaattttgttgtctactgtgtgtgtttaacgtaaatatatgtcagagtttagaatctttgcctgcagtcgtgaaaaagaaagcttaaatgatgtagttgttggcaagattgcaatgattatggaaaaatagaaagcaaatactcagtttaagccaaggaaaatatcatggatttaatatttgataaaactgattttgtttaacaggaaatgtgtagcattcactcatataatatctggttatcagcgcacgtttacacaataaatacctgagtggaggaaagttaaaaagatgagcaatagagtagaaaatatctcttaaactagttgacctagtttgtattaacagctacttaaaatgtatcaaagataggcagctattacgtagacagataaattgaaataagtggacccatgtataaaagctttgacttaaacattgatatttcagaacgtgttaaatagattaagacatagtaagttaaccctacatgttataaagatggtgactgttaacaaaggctataacagattaagtactgtttatatctagaaagtcttctctatgtagagaagtcagagagactagatgctttcactagggaatgtcttcccacccagccatcacaagtgtggacaatcactgcatccacatttgtaggcatatttttatggaagtttagttgacacctatattcattatttattttatgatttcatttttctacacctttgagatttgtgaatgcagttttttcttaaaattcatttttaacttgacagtacatttttaattcccccaatttaattaatggactgcgtgcatatatatgggagtgtgcttacatgtttataatgtactcgcatacttatgagaatttcacattggaattcataatggtaaaaaatcaaatacacctgccaatatacgttttttctgttggtttaagagaagatggccgggctcagtggctcgcgcctgtaatcccagcactctgggaggccgaggccggtggatcacctgagatcgggagttcgaaaccagcctgaccagcgtggggagaccccgtctctactaaaaacacaaagttagccaggtgtggtggcacatgcctatggtcccagctacctgggaggcagaggcaggagaattgcttgaatccgggaggcagaggttgtggtgagccgagattgcgccattgcactccagcctgggcaacaagagggaaactccgtctcaaaaaaaaaaaaaaaaaaaaaatctgacagcttcacctacttcctacagattcatctaaacccagatattgctgagaagagtgtattgacttagaatatgtattttttgtttttagttctgctgtagatcataagtgtgtaaaaaatattaagtcataatctgttacactaaaattcgtcagccaaatgttggatgagatgtctgcactgtaatctcagatcactgtcacgtatataaattgcttcttcattttaatttgtagaagaactttacagtaggaaacaccagtaaacaacttttatactgttaaaaggctttttttcccttcctaaatgctttaattgtaccatagtgttttgctcactgaagaagcttcttatggaccttgcaactttgttgctagcttgagggtgattattgtggttgtattgttcactgtgtgtagaaatagtatgagtatgatttcaatagactgttcagtttttaacattagccatagcactggttagtatctcagtagtttcatgaaacatttcccgtattagaatctattttgaaacatttatttgtgtgtgtgtgtgtcttagggtcaagtttgtaaattttaataagccacaattttaaaagatgcagtaatcttccaacttccaatatttatccattcctcgtggatccacaaattgcatctttaaattcatgatacctttccttaagtatcatatgtttccggttgttcaagcttagtgatgaggtgcaagcacaagagaaatttcagtagaatacagtttttattttgtaaacactaatgtattaaacttgttatacattaaagcaaataatatatattttatttgaattgtatatatgagttggatgttgtaactagttgactttttcattttgttagaggtattttcgctgaacaaggtcaattggttacctaagtattagggccaatatagtccaagggaccatttctccctgagtctcttacactttattgtgcgatgtccatgttttttgttgttgttgttgctgttgttttttgttttgttttgttttgagatggagtctcactctgtcacccaggctggagtgcagtggcacgatctcggctcactgcaagctctgcctcccgggttcacgccattctcctgcctcagcctcccgaggagctgggactacaggcgcccgccaccacgcccggctaattttttgtatttttagcggggacggggtttcaccgtgttagccaggctggtcttgatctcctgacctcgtgatccacccaccttggcctcccaaagtgctgggattacaggtgtgagccaccgcacctggccgatgtccacgtttttatgactcttcaagctgttggtgaggtgggacgagtgcacttgcttcctgttcctttggcaataaagattttctgtgcctccccccacaaaaaaaaacaagcataggaggaccatccccaagtaagagggatgcaccagagtttggttaagttttattaaaacttcagctgagtccaaagcactaaggtgatcaacacttcactctatcagactaagagaggaaataggacaattatatggttcttttatacattagacataagaagaagtagaatgacatgtaacctataatcaagaaaaaagcagacaatgcaagcagactcaacattgcatgaaagatacaagccttctcctgtattttcagacaaaaaaaaagtttgattcatgaaaaagtgaagattactggaaatggaacatatgaaagcaaacataaaattcatttatgtcttcatttgtgactatatgactgaatgcaccggctttgttgctgactgtcagctgacagtcatcttcatgtcttaggggccacctgcagtttccagttttttcccatgtgggctttctcatcatggctgcttacttcatcaaatcagcaagaggcatttcttacctcacagaggacccagtacctcttttaaaggcttttagctaattaagtcaggctcaccattgtaatttcctttttaagtaacccaaagtcaactgatttacaaccttaactacacctgaaaaatccctcacctttgttatattctattgactagaagctagtcagagtttccacccacactcaaggggaaaagatcatagagggcatgaacacaagggtaggggaatcttgggacccatcatagaattctgcctaccatagttagtatttatatacagagcaagcctccaggaggttaggcaaggaatagctactgaggaaataaatattactgagaaagaaacagctggacaactactagaactcacacaagactgtaagaaacttaggtgtcaaccaatcagaatgtatagacatcattgaacatccaggacattccagtagggatcccagagagaccacactttaggagtagggaacaattatctcaagggtaaaagttattctaggcccactccaacaaaaaaataaacctcaaaaggatcaagctgatgcacagtaaattgtctgctaaaataaaatttaatacaattaaataatacaacaaaatgcagacactcacactcaaaaacataccactccagcctggccaacatagtgaaaccccttctctactaaaaatacaaaaattagccgggcatggtggtgtgtgcctgtagtcccagctactcgggagactgaggcaggagaattgcttgaacccaggaggcggaggttgcagtgagctgagttcgcgccactgcacaccagcccaggtgacagtgcgagactctgtctcaaaacaaacaaacaaacaacaacaacaaaaacccataacactaataatgtccatcatacagtccaaattttttagctatggggatttctgtctcactcataggaaataattgatgtaagagtagctatctcacaataaacaactataaaactagacaaaataaatgaaacaactgctttcagacattgcacaagaagcaaagcaggacagtgatccaacagagtaggggaactaatgaggcgagtcctatatttacccaggctctttgcttcaaggcaattgccagactgcgacaaagggaggaagaacccaagtagatctcggaaattttgcggaataaaaacacaacagtctctaaataaagacaataaaatccagacatttaacatcataatttccacaatgtgtgtcacctcattaaaatatgaaccattaccaggagaaaaatcagtcaatataaacaagctcagaaatgacaagtaaaatggaattagcagacaaggactttaaatgatgtactataaatattatcaaggaattaaagctaaacatgaacacaatgagaaaatatattgaagatacaaatgaaaatgaatcagaacttctagagctgaaaaaaaaatatgaagtgaaaaagtcacttgacagatgaagagacagaagtaccagcagattagatactacagaaggaaagattagtaaatttgaagacatagcaataaaaactacccaaactgaaacaaagacaaattctgaaaaaattaaaagagcttcagtgacctgtgggataatgccagacaacctacatatcaataattgcctaaactgtgaaaaggcaaaattatcccaggaatgaagagtaaatcacaaactgctcataggagaatatactcaaataaaaatttaataaggggcattgaagaaagagacaaaaataatcaagtgaatgaaaatgaccaaagaaaaaaagtttaaagggtcagagaaaagtagtggaagtgaaaaacaggcaaagaaaaggaagaagaaaaacaagtcaatgaaatagagctaatatttaaaattataacccgagaaaaaaatcagaaatagaaaaagacctgaatctacaaattgaacaagcttcctaggtacctacaaaaatcaacctagacctatgaactgtaagatataggtaaataaaactataagattttaaagtaaatataaagccctcaactttcacttttagccaatatggaaaaacagggaacagatttactatcccacctgaaaaaaaaatgaacaaaataatggtttgcaaggcatgcaggtaaaaaggacagtgaaccctgagagatgggaaacaatggaagtaagccgtgcaattgtcccccgcttactgccttaaaagagtttccgggctgcaaggaagaaaggaagaacccaggaagagccttcatcaacttcctgagttcaggaatcagcactaacactatggggagaccaagatagctagagttcatgtaacagagaactggagatgagagtacaacacatagacagaaattggaagatctgcaaaggattcttcttaacaatttagctgatattgatcagaaattcatatgaggaaattatctaaggggaaagaaccatcagaaaataatctatggtattttgttataataacccaaacagactaagataagactatgcaaacaaatttgaaaacctagaggaaatagataatttcataagggaattcaacttactaaaattggccccatttgtgttagaaagcttaaacagaacagtttctatagaagtaatacaggaagttattaagagaatactttacaaaaaaagcaacaagcccagatggtttcacaagaagacgacaaagttagattcgtatctcacaccatgtacaaaaagatagactccaaatggattagagagctaaatgtaaaaaataagaccaggccaattactagaagaaaacatccgtgaatttctttttaaccttggtgtagggaaaggctctctaaccatgactcaaaatccagaggcaataaaagtctattaaatttgattacattttaagaatgtgcataacaaatgcaccataacaaaatcaaaacatgagtgacaaactggtagaaaatatttacgacatataacacagagaaaggacagatctatctaatatatgaagaactcttaaaaatcgaggggcaaaagcccagactttgccactatgcaatatatccatataacaaaatcgcactcgtaccccttaaatttgtacaaataaaaaatattaagggacataccaggcaggaccagagataggcaggcagttcaataagcctaatgtacagagtgggtcaaagtagtgtactatcaagctggaggtttagagtatgcttccctggtttaagaggagagatatgtttagatctgcagtttagaaagaacactctgttgacttggtgaatgtgaattagaaaagcagggagaggggttcagaaacttaaagtaatccatctgagagataatggtgcatcaaaataaggtagtgactataaggattaagaaaaaagataaagacttattaaagaggcagaatttactggatttataaaccaaattatgtgggtaaggtaggagtcctggatgaaacccaggattttaacataggcagtgagataggtggtagtcttatagagaatgtagagaatgcagggatttaaattcagtctgggccggatgcaatggctcacgcctgtaatcccagcacttcgggaggccgaagggggtagatcacttgagcccaggagttcaagactagcttgggcaacatagtgagatcccgtctctacaaaaaaatacaaaattagccaggtgtggtggcatgtacctgtagtcccagctagtctggaggttgaggtgggagaatcgcttgaacctgggaggcagaggttgcagtgaactgtgattgtgccactacactccagcctgggtgacagagcaagaccctatctcaaaaaaaaaaaaaaaaaaaaaattcaatctgaagactaaatataatggtccatatttgttcaatgctgttctaggcatatagaaaatatctaataagtttagctattgctgctgttctcttaggctaaactggtttgattaatcttaatataatttactatgaaatactatgcacagttgatattcaacattctctaagcagatctggtttcaagttgcacaactttccagctttgtgactctagacaagtttcttaacctttcttggcctcaatctccttcttgttaaatgggagtaataatatcaacccagcaatgttttggataagaaataagagaagtcaagtgcctgaagtggtgtctgtcacatagtaggatcttaataagtgataaattaaacataaagcaatattattggttttaggggattctctctcatttatctttgtatttcccatagaccccacctgcctagaacggtcttacagttgatagtaaatactgatcaaatctgtggtaactgttttctgcttgacatttttcttttattttttttcttctagtctgccaaaggctgttaatcttcattttaaaagtatcatttaaatggttagagcagcttctccttgcttaatgtttattttgcttaatctctctctctctcttatttttttttacttacaaacaaacaataacccatgcttcataatacataacactttcttgtaaaatttcttgagaactccccctatctgcactcccaagcccttataagagtttcattcagtaatagaatctcagtccctatctggcttgactgtgatgagaattacccaggctgctgaacctattccaaaattgttgctgatctccagaacttccaccagaattaagaacagtcaattaacaacttggtcaaacatgttggatttaatcatggtgaatcatagccactgaaaagacatttaatttgatctgaaatactttcacaagaatatcaaatctcaggcataatttgtgattagcaactctataaaaataaagagtaattggaaattttaaaagactaagtgtcaaaggaccagacacccaaaagtgtaactgccaattctgttgatgagtcttagggaaataggcattctcattgctactgagaatgcaaaccggtacaactctttgaggaggaatttggcaacagctaacataacctttcaactcagaaatcccagttctaagaaactatcctcgaatatgaactttttttacaattcaaaaatacatatggccaaagttattcattgcagcatagtttgtaattgcaaaatattggaaacaacttaaatgcctgaacatagaaaagtggttaaataaattatgcaacatcagctcagtggcattccatacagctgtaaaaaaaaaaaaaacaaaaaagaataaggaagatctctatgaactgatgtggagtgggtccatgacatactacccaaatgaaaaaaatctaagtacaggagaccgcttctagaatggcagagtaaggaattccaaaaatgtgtttcttaataaaagcaatgaagtctttttttatggtgaaaaaaaaagtttttttcaccataaaaactgtgaaaaatcaaattttttagaactccagaaattaacctaaggctagcaataatccacagagcgtttactcaagaaaaaaatcactacatcttggtaagaacagtgagtttcatggtgctttaacttgccctacttccattcctctcccttagtcccatagtaaccttaaaaaccaacagtgtcccaataatagtagctgtgaaaatcagtaacctagtagccactagaaagggcatagaggtttacaagcatccaaaggtcccatccccagagaaattccaattgtcagctattctgattgtccgataacttgcagaaaagttccatgctcaggagttgtcattctttgagctgactcagagcttactctgtgttaataggcttatccccaaggcatttgtcgaaaacaatcattggcaattaatatcggaactgcctgaggctacattatcagttgggattaataagaagctgaccaaaaaacttgagaggaaaaactggggaatgagatgaccatagagggctttaaaaagctccaaaatgttcctggaaatctggaagacctcacatacgcctaaggctgtgcatatgcccatgattgtgtacatgcttaggaaagatccaagaagaagaacaaagtcagaagatttacactatcacacttcaagacataccataaagctacagtgatcaaggtagtgtggtattgatgaaagaacagacaaataaatgaatgaaagagaatggagagcccagaaagagttccacacaaatatagtcaacttatttttgacaaaggagcaaaggtaattcaacggaaaaaagcattctttttaacaaatggtgccggaacaactgtacaaccacatgtaaaaagattttttaaagcccaaaaacaaataaacaaagagccccacaagaatctagagacagaatttacaccttttccccaaattaaatagatataattaaaatagactataagtgttaaatgtaaaatgcaaggctataaaacttctagaagatagcaaaggagaaaatctgagtgaccttcactttggtaatgactttaacaaaaggtcaatctataaaagaaaaaaatgataaattaaacttcattaaattcaaaactactctgttaagtgaacgaaaagacaaacaacagagtaggagaaaatatttgcaaaacatatatctgattaaggactgtatccaaaatgtacaaagaactcaaaactcaacaacaagaaaacatacaaaccaatttaaaaatgggccatagatttgaacagatgcctcatcaaagaagaggtacagatagcaaaataaacatattaaaagatgctcaacatcatatgccattaggaattcacttttatttgtaaaatagttttgcagcatataagtttcttgcttgaacagcctttttcttttagctacagtagttctcctttatctgcaagggatgcattccaagacccccagcctgaaactgtggatagtaacaaaccttatatatagtttcttctatacatacatgactatggtgaagtttaatttataaattaggcatagtgacagtcagaataacaattattaaaaagtcaagaaacaacagatgctggtgaggctgtggggaaataggcatgcttttacactgctggtggcaatgtaaattagttcaaccattgtggaagacagtgtggtgattcctcaaggacctagaaccagaaataccatttaacccagcaatctcatgactgagtatatacccaaaggaatataaatcattctactataatgatacatgcacacatatgttcattgcagcactatttacaatagcaaagacatggaaactacgcaaatgcccatcaatgatagactggataaagaaaatgtggtacatatacaccatggaatactatgcagccataaaaaggaatgagatcatgtcctttgcaaggacatggatgaagctggaagccatcatcctcagcaaagtaacacaggaacagaaaaccaaacaccacatgctctcactcataattgggagttgaacaatgagaacacttggacacagggaggggaacaacacacactggggcctgtcagggggatggggagggagagagagcatcaggacaaatagctaatgcatgcagggcttaaaatctagatgataggttgataggtgcagcaaaccaccatggcacacatatacctatataatgaacctgtacattctgcacctgtatcacagaacttaaagtaaaattttaaaaaataaattagccatagtaagagattaacaacaataataaaatgaacaattataacaatatactgtgtaaaagttatgcaaatgtggtctttttctctctctgtctctctcaaaacagcttattgtactatattacctgtttttgaattaaagttgaccatagataactgaaactgaggagagtaaaaccatggataaggggggactactgaatgttatcccactgcttcttggctttgtggtttcttatatgaaataagctgtcgatcttatgagaatgacttgtatgagatgcattgttttcttcttgatgcttgcaatattctttctttgtcttctgacagtttgagtatggtgtgtcaaggtgcagatctctttgggtttctcctacttggaggtcatttagcttcttagataggcagatcaatgcttttcatctaatttgggaggtttcggccattgtttcttcaaatagtcttactgccctgctacggtttgaatatgtcccctccaaaattcaggtgttgtcaatgtcatagtgttaagagatggggcctttaagaggggattagccatgagggctcctccttcataactgggattagggcctttataaaaagaagcttcacacaccttttggcccttttgctccttttgctcttctcccatctgccttgtgaggacacagcattcttcccctctgaagggtgcggcaataagttcaccatcttggaggcagagagcagccctcaccagaaaaccaaacctcccagcaccttgatcttggatttcccagcctccaagactgtaagaaatatatttctgttctttatatgttacccagtctctagcgttctgttacagtagcacaaataaaccaagacatgccccattctctctctcccctctctttctataactcccattatgttaatattcttgatggtatcccacaggtccctaaggctcagttaatttttttaaaaaaatgttctctgttccccacacttggtaatgtcaatttatctactttcaagtttgctgtttttatcttctgcctactcaaatctgtggagccccctctagtgaatttttcatttcagtcatattttttacctcagaatttctgtttgtttcttttttataattttatttctttattgatattctcattttggcgaggcatccttttcatactttctttagttctgtagacattgtttccctttagttgtttcaatgtatttaaaatagcaaacttcaagtctttgtcaagtaattccaatgtctacactttctcagaacagtttctcttgactgggtttttaaacatttattttccctatcaatttcctgtcttcagtgtcattgatttctgctcagtcctttatttatttattttttgcttgttttaggcttatatttatcttctttttttgttgttctttttttttttttttttttttttttgagacggagccttgctctgtcgccaggctggagtgcagtagagcgatctcggctcactgcaacctccacctcccggattcaagcaattgccctgcctcagcctcccgagtagctgggagtacaggtgcgcgccacgacgccctgttaattttttgtattttagtagatacggggtttcaccatgttggccaggatggtctgaatctcctgacctcgtgatccgcccgccttggtctcccaaagtgctgggattacaggcgtaagccaccgcacccggccctatttatcttctttttctatgtttactttattttatttcatttcattttttaagagatgagattttgccctgtcacccaggctggagtgcactggcttatcatagctcactgtagcctcaaacttctgggctcaagcaagctcctgctaggtttgtttgtttgtttgtttttctgttgtttttatttgtttgttttgaggcggagtctcactctgcccacgctggagtgcagtggcactatctcagctcactgcaacctctgcctcccaggttcaagtgattctcctgcctcagcctcctaagcagttgggattacaggcacgcaccacaatgcctggctattttttgtattttttttagtacagaaggggtctcaccatgttggccaggctggtgtcgaactcctgacctcaagtgatccccccatttcggcctcccaaagcgctgggaccagaggcgtgagccaccacacccagccccttctctagttttccaagatggaagcttagattattgattttagattttctttcctcatatatgcattcaatgctataaatttcctcctaagcactacttttgctgaacctcacaaattttggtaattgtattttcatttttatttaattcaaaatattttttgaatttctcttgtgatttcttggcccatgagttgtttagaagtgtgtcatttaatgtctagttatttggagaatttctctttttttcctcaatccttagaacctgctaatatttgggggctggggggcggttgtagctatttctctgtcattgatttctagctctagtttaattccatgttagtctgagaagacacttcatgtgatttctattccttcaaatttgttaaggtgtatttattttttatcagaatgtaatctatcctgatgaatgtgagcttcagaacaatctatattctgcatttattggatgaagtattacataaatgctaattatacacagttgattgataatactgttcagtttaacagtgttcttactgacctgccacctgttggatctgttcaattgctgatagaggggtatggaagcctccaactttatttgtggaattgtctatttctccttgcagttctatcagttttttgcctcatatattttgacacttggttgataggggaaaacaccttaagaattgctcttaagaattgtcacttattcttggagaattgacccctttatcatcatgtaatgccctctatatccctgattatttcccttgttctgaggtgtgctttatctgaaattaatatagctactatagctttcttttgattagtgttagcatgaactacctttttccatccctttactttaaatctaactgtgtctttacatttagtgtggatttcttataggtaactctgtttggtcttatttttataatccactctgacagtctatgtctgataatttatttttttaatttttatggctacacagtaggtgcacatgtttacggggtacatgagatgttttgatacaagtatataatgtgtaatagtcagggtaaatggggtagccatcagctcaaaaattcatcatttctttgtgttatgaacattcaataaagctgccaagaacatgcattggggaaaggatagtctcttcaataaattgagctgagaaaactggatatccatatgcagaagaatgaaactagaccctgtctcttactatatacaaaaatcaaatcaaaatggatcaaagacttaaatctaagaccttaaattctgaaactacgacaagaaaacattggggaaaatcttcaggacattagtctggacaaaaattttctgagcaatactccacaagcacaggcagccaaagcaaaaatggacaaatgggatcacatcaagctaaaaagcttctgcacggaagaggatacaatcaacaaagtgaagagacaaaccacagaaagggagaaaacatttgcaaattacccatctgataagggattaataaccagaatttatatagaactcaaacaactcaatatggaaaacattccaattgtactccctcagttattctaaaatgtacaacaaattattgttgactgtagtcaccctgttgtgctatcaaatactagatctcattcactgtatcttactatattttgtacccattaaccatccccatcacccttatcccactacccttccaatcctctgtgatccatcattctactgtctccatgagttcaatttttttaatttttagatcccacaaatgagtaagaacatgtgaaatttgtctttctgtgtctggcttatttcacttaacattatgtccttcattttcatccatgttgttacgaatgacataatcttgttctttttatggctgaatagtgctccattgtgcatatgcaccacattttttatccatttgtctactgatgtacatttaggttgattccaaattttggctattgtggatagtgctgcaataaacatgggagtgcagataaatgtttgatatactgatttcttttcttatgggtatatatctggcagtggcattgctgaatcatgtggtagttctatttctagtgttttgaggaccctcaatactggaggatcctatgtacatggaggatactctatggtagctgtactaatttacattcccaccaacagtttacaaagggtctcctttctccacattttcgctagcattcgttattgcaggtcttttagataaaaaccattttagctggggtgaaatgatatctcattgtagttttcatttgcatttctattatgatcagttatgttgagcaccttttcacatacttgtttgccatttgtatgtcatcttttgagaactgtctattcagatctcttgcccattttcaaattggattattttttccttaatgagtggtttgagctccttagaatttctggtaattaatcccttgtcagatggttaccatatagctttacatcttttatgtagtcatattgtcaatattttactttatagcttttgagttcaggcattttacctcagggaaataattcttttgtatcttctccttaaactccatagttttacatttagatctttaagtaacctgatttttttaatataatgaatgaactaggtatctgtatatgttttcctctatatagatagttaatagtccctgcattctatttgttgaataatacttacttatcccactgacttgaaataccaaccttattaaatagtacattcatagacagacttatgcgtttgtttctaaaatgcttattctgttccactgattgactaaactctttctgtgctggttccacattgttttcattaatgagactttagtacatatgtcctctcttattattcttctttttcaaatatatcttatttataattacattaagaagaaattcagaatcaacttgtaaagttcaaagaataacttttattgtgttgaggtatgtttcttccttctatgcccaggtttttaagggttttactatggagagatgttgaatttattgaatgctttttcagcatcaattgaaatgatcatatggattttgtccttcactctgttgatatgatatatcatattgattgatttgcataagttttatcatccttgcatccctggggtgaaccctgcttggtcataatgaatatattttttagtaagttaacaaatacagtttgctagtattttgtcaaaggtttttgcattaatgttcatcagatatattggcctgtagttttctttttttgatatttgtttggttttggtatcagggtaatactggcctcatagaatgagtatgaaagtattccctcttactttaatttttggaatagtttgagtaggattggtattagttctcctttaatgtttggtggaaaaagctggcagagacacaatgaaaaaaaagaaaacttcagagcaatatcactgatgaacacagatgcaaaaatcctcaactaaatactagcaaaccaaatccaggagcacatcaaaaaggtaattcaccatgatcaagcaggcattattcctgggatgcaaggttgattcaacatatgcaaaccaataaatgtgattcaccacataaacataactaaaaatgaaaaccatatgatcatctcaatagatcagaaaaaaacttttgatagaatttaacatcccttcatggtaaaaaccctcaacaaatgaggcactgaaggaacatatatcaaaataataagacccatctatgagaaacccacagccaacatcatactgaatgggcaaaaactggaagctttccccttgagaactggaacaagacaagaatgctcatactcaccactcctattcaacatagtactggaagtcctagccagggcaaccaggcaagagaaggaaataaaaaacatacaaataggaaatgaagaagtcaagctatctctcttcattgatgatatgatttatcaatgatcgtcaatgattcatcaatctaggtatatgatatacctagaaaaccctaaagactctgccacaaggctcctagagctgataaatgacttcagtatagaaaaatcattagcatttctataaatcaataatgtccaagctgagagacaatcaagaaggcaatcccatttataatagccacagaaagaataacatacctaagaatgtagctaaccaaggaggtgaaagagatccaaaaggagaattataaaacattgcctaaagaaatcagacataacacaaataaatggaaaaacatctcacgctcatggattggaagaatcaacatcattaaaatggccatactgctaaagcaatttacagattcaatgctattcctatcaaactaccaatgtcatttttctaagaataagaacaaattattctaaaattcctgtggaacataaaacaacccaaatagccaaagcaatcctaagcaaaaaaaaacaacaaagccagaggcatcacttctcctaactttaaactatactacaaggctacagagtaacagaaacagcatggtactggtacagaaacagacatgtagaccaacggaagaaaatagaaaaaaaaatagagaaaccagcaataaagctgcacacctacaacctcctgatcttcgacaaagccaacagacataagaaattgggaaaagattccctatgcaataaatggtcctatgaaacttgacccctacctatcaccatatataaatattaactcaagatggattaagtctttactccatcttgaattaatgtaagacctcaaactacaaaaatcctaaaagaaaacctagaaaactcccttcctaatatcagccttggaaaagaatttatggctaagtcctcaaaagcaattgcaacaaaacaaaaattgacaaatgaaacctaattaaactaaagagcttctgcacagcaaaagaaactaccaagtaacagaccacctataaaataagagaaaatattcacaaactatgcatctaataaatgtctaatatacaacatttataaggaacttaaatcaacaaacaaaaaagcaaaagcaaacaaccccattaaaaagtagacaaagggctgggtgcggtggctcacacttgtaatcccagcactttgggaggccgagatgggcggatcacctgaggtcagaagttcgagactagcctggccaacttggcaaaaccctgtctctactaaaaatacaaaaattagctggatgtggtggcgagcgcctgtagtcccagctactcaggaggctgaggcaggagaatcacttgaacccaggaggcagaggttgcagtgagccaagatggagccactgtagtccagcctgggtgacaaagcgagactctgtctcaaaaaaaaaaaaaaaaagtggtcataggacatgaacagacacacttctcaaaagaagacgtacaagtggccaagaaacatgaaaaaatgcttgtcatcaccaatcatcagagaaatgcaaatcaaaaccacaacaagacatactatttcacaccagtcataatggctattataaataagccaaaaaacaacagatgctagtgaggctgtggagaaaagggaacacttatacactgctgttgggaatgcaaattagttcagccactgtggaaaggagtttaaagacttctcaaagaactcagagttgaactaccatttgactcagcaatacaactactgggtatatacccaaaggaaaataaattgttctaccaaaaagacatatgcatctgtatgttcattgcagcagtattcacagttgcaaaaacatggaatcaacccagctgcctgtcaacagtggactgcataaataaaatgtggtatgctacacagccattaaaaagaatgaaatgatatcctctgcagcaatatgtgtatagctggaaaccattaccctaagcgaactaacatagaaataaaaccaaataacacgttttcagttataagtgggagctgaatattaggtacacaaggtcataaacatgagaacaatagataccggagaatgcaagaaggggaggaagggaggtggataagggttgagaaaaacctacatgttgggtactatgcttaccacgtgggggatggattcattcatattccaaacctcagcaccacacaatatacctatgtagcaaacctgcacatgtatcccctgattctgaaataaaagttgtaaacaaaactggtagaatccagcaatgaaaccatcaagtgtcagttgttttttgctggaggacctttattagggctttgatctcattacttgctgttggtctattcaggttttggatttcattatgtttccatcttggtagattgtatgtgtctaggaatttatccatttcttctaggttttccaaattattggcatatagttgctcatagtagtctctaatgatactgtgaatttctgaggtatcagcctaacgtctccattttcatctctgattttattcatttgggccttctctctttttttcttagtctagtcaaaggttggtcaattttgcttatcttttcaaaaaaatgacttttcatttcattgatctttcatttttttatttttttatttttttttatactttaagttctagggtacatgtgcacaacgtgtaggtttgttacatatgtatacatgtgccatgttggtgtgctgcacctgttaactcgtcatttacattaggcatatctcctaaagctatccctcctccctccccccaccccacaacaggccccgaagtgtgatattccccaccctgtgtccaagtgttctcattgttcaattcccacctatgaatgagaacatgcggtgtctggttttctgtccttgtgatagtttgctcagaatgatggtttccagcttcaaccatgtccctataaaggacatgaattcatccttttttatggttgcatagtattccatggtgtatatgtgccacattttcttaatccagtctatcactggtggacatctgggttggttccaagtctttgctattgtgaatagtgccacaataaacatatgtgtgcatgtgtctttatagcagcaagatttataatcctttaggtatacacccagtaatgggatggctgggacaaatggtatttcttgtcctagattcttgaggaattgccacactgtcttccacaatcgttgaactagtttacagtcccaccaacagtgtaaaagtgttcctatttctccacatcctctccagcacctgttgtttcctgactttttaatgatcaccattctaactggtgtgagatggtatctcattgtggttttgatttgtatttctctgatgaccagtgatgatgagcattttttcatctgtctcttggctgcataaatgtcttcttttgagaagtgtctgttcatatcctttgcccactttttgatggggttgtttttttcttgtaaatttattcaagttctttgtagattctggatattagccctttgtcagatgagtagattgcaaaaattttctcccattctgtaggttgcctgttcactctgatggtactttcttttgatgtgcagaagctctttagtttaattagatcccatttgtcaattttggcttttgttgccattgcttttggtgtattagtcatgaagtcctttcacatgcctatgtcctgaatggtgttgcctaggttttcttctagggtttttatggtttttaggtctaacatttaagtctttaatccatcttgaattaatttttgtataaggtgtaaggaagggatccagtttcagctgtctacatatggctagccagttttcccagcaccatttattaaatagggaatcatttccccatttcttgtttttgacaggtttgtcaaagatcagatggttgtagatgtgtggtgttatatctgagagctctgttctgttccatttgtctatatctctgttttggtaccagtaccatgctgttttggttactgtagccttgtcgtgtagtttgaagtgaggtagcgtgatgcctccagctttgttctttttgcttagattgtcttggctatgtgggctcttttttggttccatatgaactttaacatagtttttccaattctgtgaagaaagtcattggtagcttgatggggatggcattgaatctataaattaccttgggcagtatggccattttcacaatattgattcttcctatccatgagcatggaattttcttccatttgtttgtgtcctcttttatttcattgagcagtggtttgtagttctccttgaagagatccttcacatcccttgtaagttggattcctaggtattttattctctttgtagcaattgtgaatgggagttcactcatgattgggctctctgtttgtttgttaatagtgtttaggaatgcttgtgatttttgcacattgattttgtatcctgagactttgctgaagttgcctatcagcttaaagagattttgggctgagacgatggggtattctaaatacacaattatgtcatctgcaaacagggacaatttgacttcctcttttcctaattgaataccctttatttctttctcttgcctgattgccctggccagaacttctaacactatgttgagtaggagtggtgagagagggcatccttgtcttgtgccggttttcaaagggaatgcttccagcttttgcccattccatatgatattggcggtgggtttgtcataaatagctcttattattttgagatactttccatcaatatctagtttattgagagttttagtatgaagtgcagttgaattttgtcgaaggcctttcctgcatctattgagatagtcatctggtttttgtcattggttctgtttatgtgatggattatgtttattgatttgcgtatgttcaaccagcctttcatcccggggatgaagccgacttgatcgtggtggataagctttttgatgtgctgctggattcagtttgccagtattttattgaggattttttcatcaatgttcatcagggatattggtctaaaattctctttttttgttatgtctctgccaggctttggtatcaggaagatgctgacctcatacaatgagttagggaggattatctctttttctattgattggaatagtttcagaaggaatggtaccagctcccccttgtacctctggtagaattcggctgtgaatccgtctggtcctggactttttttggttggtaggctattaattattgcctcaatttcaaagcctgtgattggtctattaagagattcaacttcttcctagtttagtcttgggaggatgtatgtgtccaggaatttatccatttcttctagattttctagtttatttgcatagaggtgtttatagtattctctgatagtagtttgtatttctgtgggattggtggtgatatcccctttatcattttttattgcatctatttgattcttctctcttttcttctttattagtcttgctggtggtctatcaattttgttgatcttttcaaaaaaccagctcctggattcattgattttttggaagggttttttgtgtctctatttccttcagttctgctctgatcttagttatttcttgccttctgctaccttttgaatgtggttgctcttgcttctctagttcttttaattgtgaatgttagggtgtcaattttagatctttcctgctttctcttgtgggtatttagtgctataaatttccctctacacactgctttaaatgtgtcccagagattctggtatgttgtgtctttgttctcattggtttcaaagaacatctttatttctgccttcatttcgttatttaaccagtagtcattcaggagcagattgttcagtttccatgtagttgtgcagttttgagtgagtttcttaatcctgagttctagtttgattgcactgtggtctgagagacagtttgttgtgatttctgttcttttacgtttgctgaggagtgttttacttccatttatgtggtcaattttagaataagtgtgatgtggtgctgagaagaatgtatattctgttgatttggggtggagagttctgtagatgtttattaggtctgcttggtgcagagctgagttcaagtcctggatatccttgttcacctttcgtctcattgatctgtctaatattgacggtggggtgttaaagtctcccattattattgtgtgggagtctaaatctctttgtaggtctctaaggacttgttttataaatctgggtgctcctgtattgggtgcatatatatttaggatagttagctcttcttgttgaagtgacccctttaccattatgcaatggccttctttgtctcttttgatctttgttggtttaaagtctgttttatcagagactaggattgcaaaccctgcttttttttcttttttttttagctttccagttgcttggtagatcttcctccatccctttattttgagtctatgtgtgtctctacacatgagatggatctcctgaatacagcacactgatgggtcttgattgttcatccaatttgccagtctgtgtcttttaattggggcttttagcccatttacattaaaggttaatattgtcatgtgtgaatttgatcctgtgattatgatgttacctggttattttgcctgttaattgatgcagtttcttcatagcatcaatggtctttacaatttggcatgtttttgcagtggctggtaccagttgttcctttccatgtttagtgtttccttcaggagctcttgtaaggcaggcctggtgatgacaaaatctctcagcatttgcttgtccataaaggattttatttcaccttcacttatgttgcttactttggctggatatgaaattctgggttgaaaattcttttctttaagaatgttgaatattggcccctactctcttctggcttgtaaggtttctgccgagacgtccgctgttagtctgatgggcttccctttgtgggtaacccaacctttctctctggctgccctttacattttttcctacatttaaaccttggtgaatctgacaattatgtgtcttggggttgcccttcttgaggagtatctttgtggtgttctctgcatttcctgaatttgaatgttggcctgtcttgctaggttggggaagttctcctggataatattctgaatagtgttttccaacttgattccattctccctgtcactttcaggtacaccaatcaaatgtagatttggtcttttcacatagtcctatatttcttggaggctttgtttgtttctttttcctcttttttctctaaactcgtcttctcgctttatttcattaatttgatcttcattcactgatatcctttcttccatttaatcgaatcggctattgaaggttgtgcgtgtgtcacgtagttcccgtgccatggttttcagctccatcaggtcatttaaggtcttctctacactgtttattctagttagccattcgtctaaccttttttcaaggtttttagcttccttgtgatgggtagaacatgctcttttagcttggagaagtttgttattaccgaccttctgaagcctgcttctgtcaacttgtcaaagtcattttccgtccagctttgctggcgaggagctgtgatcctttggaagagaagaggcactcttgtttttagaattttcagctattctgctctggtttctccccatctttatggttttatctacctttggtctttgatgttggtgacctacagatggggttttggtgtggatgtcctttctgttgatgttgatgctattcctttctgtttgttagttttccttctaacagtcaggtccctcagctgtaggtctgttggagtttgctggaggtccactccagaccctgttcacctgggtatcaccagcagaggctgcagaatagcaaatattgcagaacagcaaatattgctgcctgatcctttctctggaagctttgttccagaggggcacccacctgtatgaggtgtctgttggctcctactgggaggtgtctcccaattaggctacatgaggggtcaaggacccacttgaggaggcagtctgtccattctgagagctcaaacgccgtgctgagagaaccactgctctcttcagagctgtcagacagggacatttaattctgcagaagtttctgctgcctttttttcagctatgccctgcccacagaggtggagtctatagagccagtaggccttgctgtgctgcagtgtgctctgcccagttccagcttcccagccattttgtttacctactcaagcctcagcaatggcagacgcccctccccccaccaggctgctgcctcgcaggtcgatctcagactgctgcgctagcagcaagcaaggctatgtgggcatggtaccctccgagccaggcacgggagagaatctcctggtgtgctgattgctaagaccatgggaaatgtgcagtatttgggcgagagtgtcccgtttttccaggtgcaggctatcatggcttcccttggctaggaaagggaaatccctcaaccccttgtgcttcccgggtgaggcaacaccctgccccacttcagctcaccctctgtgggctgcacccactgtccaaccagtcccaatgagatgaaccaggaacctcagttggaaatgcagaaatcacctgtcttctgtgttgatcacgctgggagctgcagaccggagcttttcctattctgccatcttggaacggatcatattggttttttaaatttcaatttcctttatttctgctctgatctgtattatttcttttcttctactaattttggttttggtttgctcttgcttttctaattctataagatgtataattaggtggtttatttgaagtttttctactttttgatataggtgcttattgctataaaccttcttcttagtactgctctcactgcatcccataggttttggtatgttgcgtttccattgtcatttatttcaaatttttcagtttccttcttaatttcttcattgacccagtggtcattctggagcatattgtttaatttccatgtattcgtatgtttccaatattcatttctttattaatttctagtgttgttccatgtggtcagagaagatgcttgatattgtttcattttttgaatgttttaagacttgttttgtcacctaatatatggtccatccttgagaatgatccatatgctgaggagaagaatgtgtattctgcagacattggataaaatattctgtaaatatctattagatccatttgacctatagtgcagattaagtctgatgtttcttcattgattttctgtctggatgatctgaccaatgctgaaagtggggtactgaaatctcaaactcttattgtattgtggtctatctctctccttagctctaataatatttgctttgtatatctgggtgctccagtgttgggttcatagatatctacaattgttattttctcttgctgaatttatccttttatcattataatgaccttctttgtctcttttcatagtttttgtcttgaaatctattttggttgatataagtatagctactactgctttttttttgtggtttccattttcatggaatatctttctccattactttataggtgtagtgtgtttctcatgggtaatagatcattgagtcttttttaaatccattcagccactgtgtgtcttttgattgcagagtttagtctgtttacattcaatcttatgatttataagtaaggatttactactgccattttgttttgttttcttgttgttgtgtggctggctggcctgcctgcctgccttccttccttccttctttccttccttccttcccgttcttctttcctttgtcttcccttgtatgaaagtgattctctctgacggtatgttttaatttcttgctttatatatttttgtgtatctgtggttggtgtttatttgaagttaccatgaagcttgagaataacatcttataactcattattttattttattttttaatttaacttttatttcaagttcaggggttcaattacctaccaagttaaacttttattttaagttcaacaaacatgtgcaggtttgttatagaggtaaacttgtgtcataggacattgttgtatagattattttatcactcaggaattaagcatagtacccattagttattttttctgatcctctctctcctctcatcttccaccctctcataggcctcagtgtgtgttgttcccctctatgtgtccatgttttctcatcatttagctcccacttataagtgagaacatgtggtatgtggttttctgttcctatgttagtttgctaaagataatggcctccatcttcatccatgttccctcaaaggacatgatctcattctttttatggctgtatagtattccatggtatatatgtaccatattttctttatccagtctacctttgatgggcatttaggttaattccatatctttgctattgtgaatagtccttcagtgaacatacgcatgcatgtgtttttatgatagaatggtttctattcctttgagtatatacccagtaatgggattgctgggtcaaattgtatttctgtttctaggtctttgaggaattgatacgctgttttccagaatggttgaactaatttatactcccaccaacaatgtctaaatattcctttttctccacaaccttgccagcatctgctattttttgactttttaataaaagccattctgactggtgtgagatagtatctcattggggttttgatttgcatttctctaacgatcagtgatgttgaacttgttttcatatgcttgttggctgcgtgtcctttgcccactttttaatagggttgtttgtttgttttttccttgtaaatttaagttccttataaatgctggatattagacctttgtcagatgcatagtttgcaaaaagtttctcctgttctgtaggttgtctgtttagtccctcgatagtttcttttgctgtgtagaagctctttagtttaatgaggtctcatttgtccatttttgtttttgttgcaattgcttttggtgtttttgtcatgaaatctttgcccattcctttgatatactgatttcttttctgttgaatatatacctagcagtgagattgctggatcatatgatagctctattattagttttttgaggggactctaaactgttcttgatagtgattgtactaatttatattcttaccaacagtatataacagttcccttttctccatacctttgccagtattttttattgcctcacttctggataaaagccattttaactagggtgaaataatctccttgtagtattgatttgcatttatctgatgatcagtgatgttgagcaccttttcacatacctgtttgccatttgtatgtcctcttttgataaatgtctattcaggtatcactcccatgtttatcacagcactattcacaatagccaagatttggaagcaacctaagtgtacatcaacagatagatggatgaagaaaatgtgatacatagacacaatggagtactattcagccataaaaagcatgagatcctgtcatttgcaacaacatggatggaaccagaggtcattatgttaagtgaaataagctaggcacagaaagacaaacttcatatgttctcacttatttgtggtagctaaaaattaaaacaattgaactcacggtaatagagagtaaaacgatgattaccagagtctgggaaggatagtgggggtcaggtggggggatggttcatgtgtacaaaaatatagttagataaaatcaataagatctagtattttatagcacaactgggtgattattgtcaagaataatgtatacatttaaaaataactaaaagagtataactagtttgtttgtaatgcatagaaaggataaatgcttgaggtgatggatactccattaaccctgatgtgattattatgcattgtatgcctgaatcaaaatatctcatgtacctcataaatatatacacctactatgtacccacaaaaattaaaaataaaaattttttaagtggatgaaagacttaaacctaagacctaagactatgaaactactagaagaaaacgttggggaaatgctttaggacatttgcccagtttaggcaaagattattttgtaaacctcaaaatcacaggcaaccaaagcaaaaatagacaaatgggactacatcaaactaaaaaacttttgcactgcaaaggaaacaatcaactagtgaaaagataacccacagaatgaaagaaaatatttgcaaactattcatctggcaaatgattaaaaaacaaaatataaagaactgaaaaacctcaatagtaaaataacgataataatctgatttaaaatcaggcaaaaaacctaaataaatgtttctcaaaaggagctatataaatggccaacgggcatgtgaaaaaaatgcccaacatcacaaatccttatggaaattcaaaccaaaaccacacgagatatatcttaccccagctaaaatggctttatcaaaaagagagacaacaacagatgctggtgaggatgtggagaaagggataccctcatatactgttggtgaatgtaaattagtacagtcactatgaaaaactatatggaggtccttcaaaaaaaataaaactagagctaccatatgatccagcaattccactactgggtacacatccaaaagaaaagaaatcaatatattgaagagatatttacactcccatgtttactgcagcagtatttacgatagccaaaatatggaatcaacctaagtgcccatcaaaggatgaatggataagaaaatgtggtatagatacacaatgaaatattattcagccataaaaagaatgaaatcctgtcatttgcagcaacatggatggaattggaggtcattatgttaagtgaaataagccaaacacaaaaagacaaatattgcatgttctcattcatatgcgggagctaataaacatggatctcataaagatagagggtagaattgtggttaccagaagccaggaaggatagaagggagggaggataaaaagaggttgattaatgggtacaaatgtacaatttgaaagaagaaacaagacctagtgtttgaaagatcagtagagtgactatagtttacaatgacctattgtatatttcaaaatagctaaaaaagaataattcaaatgtttctaagataaaaaagacaaatatttaaggtgatggatatcccaatgtactgttttgatctttacaaattatatgaattatttaattatcacatgtactctgaaaatatgtacaactattctgtataagtaaaatttttgaaattaaataaaatcagaactacttgtggctctaaaaaaaaaaaaaaaatctttgcccattcctatgtccagaatggtattgcctaggttttattctagggtttttatagtttttggtgttacactgaagtctttaattaatcttgagctattataatttttgtttaggttgtaaggaaggggtctagtttcagtcttctagatatggctagccagttgtcccagcactatttattgaatagggagttctttccccattgcttatttctgtcgggcttgtcaaagatcagatagttgtaggtgtgtcgccttatttgggggttctctattctgttccactgataacccattatttgaaagtgatgacaacttaagtctgattgcaaaaacaaacaaacatgcaatgataaaactcataaaattctacattttaacttcatctctcctgctttttaactttttgttttttctatttatatattattatactttctacgtcttcaaaacttgttcaaaacttttgataggttcatcttttattctctgactcaagatgtgagtagtttacacactacaattatagtggcataatattctgtatttgtctgtgtacttactgctatcagagagtgttgtaccctcagatgattgcgtattgctcatcaatgtccttttctttcagattgaagaactccctgtagcatttctttttttttttttttttactttaatttttaatttttgtgggcacctgataggtatatccatgtatggggtatgtgagatgttttgatacaggaatacaatatgtaataatcacatcagagtaaatgaggtatccatcacctcaagcatttatccattctttgtgttacaaacaatccagttatactcttttagttatttttaaatgtaccactaaattatttttcactatagccctcctcttgtgctagcaaatactaagtcttattcattctttctattttttttgtgcccattaactctccccactttccctcaccacccaccactacccttcccagcctctggtaaccatccatttactctctatctccatgagttcaattgtttcaaattttaggtccccagattattgagaacatgaaatgtttgtctctctgtgcctggcttatttcacttcatattatgacctccagttccatccatgttgttgcaaatgacaggatctcattcttttttatggctgaatagtactctactgtatatatgtgccacattttctttatctattcatctgttgatggacacattgcttccaaatcttgactattgtgaatagtgctgcaataaacatgagagtacagatacatgtttgatatactgatttcctgtcttttggttatatacctaggagtgagattgctggattgcaaggtaattctatttttagtttcttgagggacctcaaaactggtctccacagtagttgtactaatttaccttttcaccaacagtgtacaagggttcccttttctccatattcttgccagcacttgttattgcctgagttttggatactttagcatttcttataggactggtctggtattgataaaatccctcagcctttgtgtgtctgggaaagtatttctccttcatgtttcaaggatatttttactgaatatactattctaggataaaagattttttcctttagcagtttaaatatatcatgcccctctctcctggcctataaggtttccactgagaaatctactgccagacatattgaaactccttttgtgtttgtatgtttgttcatttttacttttctcttgctgcttttaggatgctttctttatccttgacctttggggccaggcacaatggctcatgcctgtaatgccaacattttgggaggccaagtcaggtggattccttgagcccaggagtttgagaccagcctgggcaacacagcgaaaccacatctctacaaaaacaaacaaaaaaagcccacaatatattcttgacctttggcagtttgaatattacatgtcttgacatagtcttctgggggttaaatttgtttggtattctataaccttcttgcatttgaatattgacatttttctctaggtttaaaaagttctcattattatctcttcaaataatctttctattccactctctctctctctaccgcctctttaaggccaatactcttagatttgctcttttgtggctactttctagatcctatagtcatactttattattttgtattctgttttttttttattcctctgactttgtgtttttaaatagactgtcttcaagctcgctaattgtttcttctgcttgatcagttctgctgttgagaaactctgatgtattcttcaagttgtcaattgaatttttcagctccagaatttctgcttaattttgtttagttacttgcatctctttgttaaatttatctgataggattttgaatttcttctctatgttatcttgaattgtgttgagcttcctccaaacagctattttgaattctctgtctgaaaggtcccatatctgtgtcactctggaattggtcactggtgccttatttagcttgtttggtgaagtcctgttttcctgaaaggtcttcatgtctgtgggtattcatcaatgtctgggcattgaagagttaagtatttcttctaatttttgcagtctgggcatgtttgcacccattcttcttgagaaggctttccaagtattcaaagatgattgagtgttataatctaagtgtttggtcattgcagccatatgtgcattagagggcactctaaacccagtaattctgtgatttttgcagacttgtagaggtgccacctggacagtgttgggtaagacctgagagaattccatggattaccaggtagtctcttgttctcttccattttcccaaataaatagagtctctctctgtgtgctatgttgcatggatttgggagagaggtgatgcaagtactcccgtggctaccactgctgggactgtactgggtcacacctgaagccagcacaggacggggtcttgtcctaggcctgggtggcggctatttcctgcctatcattgatgtttattcaaggctcaagggctctttagtcagcaggtgaagaatagtgccaggactggatctttcttttgggtagtgggctcccttctggcccagggcaggtctagaaatatccttcaggagctgaggcctggaatcagggtctttaggggtctgtttggtattttattttactgtggctcagttggtacccaagttgcaaggcaaagtccattttactcttccctctcctttcctcaagcagaagaactctctccccatggccactagagctgggaatgtgctgggtcacacctaaagccagcatggtactgggtcttgcccaaggcccgtgatgactgctgcctggctactactgatgtttattcaaggcccacaggctatttagtcaggaagtgatgaattctgccaggactgggtcgttccattcaaggcagtagattcccttctagcctggggtgggtctagaaatgtcatccaggagatatagcctggaatgtgaatttcaggactctgcctggtgccctgtcagctgtggctgagctggtatccaagttgcaagacgaagtcctctttattcttccttctctcctcaaacagatggaaggactttcttgaggagctgtgaatgatgctgactgggattaggggaagggtggcacaagcactcccttggctgccctagctggtgtcttactgggttgcatgaccccctggtctactgtcccctagcctagcacggcaccaggacttgcccaggaattgcagtccttatggctagactgcctttcaagtttatttaggaccccagagtgttttagcctatggtggtggggcttgccggaactcacctttcaaccactgagatggacaatttccctctggctagggctgatctaatgccctctccatgggagccagctgaattctgtcctgtgttgctttccactgtgataggacagcactgagttccaatgcaaagtcccgcaatcactttgctctccctcttttaagcacacagattctgtctctgagccatgcagtactgcctggggttgagggaagggtggcaattcaagactgtctttcctaccctcttcagtgcctctttcagtaatatgatgttaaaattggatactatgattgctcacctgatgtttaattcttatgaacatgctttcttgtgtggatagttgttcaatttggtgttctggggggggaataatcactggaggcttttattcagctgtttttctccacctcccttgttaattgatgtcttaaaccattcacatttaagtgattattgatataattggattaatatccaccatatttgtaatcgttttctattcattgctttgttctttgtttctcaggggtttttttttgccagttttttgtttttttgtttgtattagtccattctcacgctgctataaagatactacctgtggctgggttataaaggaaaaaggtttaattgacttacagttctgcatggctagggaggcctcaggaaacttacaattatggcagaaggtgaaggagaagcaggcaccttcttcatagggcagcaggagagacagagagtgcaggggaaaatgccacttttaaaagcatcagctctcacaagaactcccatgatctaatcaccccccaccaggtccctccatcaacacgtgtggtttacaattcgagatgagatttgggtggggatacagaaccaaagcatatcattgtttctttggtttttctgtcttccactctttttctgccttttctgggttgaagtgaacattttgtgattccattttctctcctctcttatatactgattgcacttctttgtttattttttagtggtttccctggagtttgacatatacatttacaactaatctaaaccaactttcaaataacactatactacctcccagatagtgcaggtaccttattacagagtattcccaattcttccttaccctccctaataatattgccgtcattcattcacttatccataaactataatcaaccgatacattgttgctactatgattttaacaaactgttacctactggatcaattaagcataagaaaaatggatttaatttgccttcatttattgcatttctaatgttcttcttttacttatgcagaaataagcttctgaccttttctctgaggaaccattttttaacatttcttccaaggtaggtctattagtgacaacgtccctcaatttgtatttgtctgagaaagcctttatttctccttcacttctaaaggataattacgttcaatatatatatccaggctgttgggtttttttctttcaacattttaaatagttcactccaccctcttttcacttgggtgctttctgaagagaagtccaatgtaattcttactgtttgcctctatagataagatttcttttcctctcaattctttcaagatttttttctttccctttgattttctgcagtttgaatatgacatgcctaggtataaagttttggcatttatcctgcttagtgttctctaagcttcctggatctgtagtttgatgcatgaaactaattttggaaaactctcagccattatcacttcaaagatgtttttagttcctttctcccttttctttctaatattctcgttatacataggttacactgtttgtaattgttccacatttcatggatgctctgttatattttttttcattcctttttctctttgcttttcagtttggaaaatttctattgtcatatcttcaagttcactgattccttgttcagaagagtccagccaactaatgagcccattaaagctaatctccatttctgtgacagtgttttttatttctagcatttcctttgatttttcttagagtttccttctctcatgttactcatccgttcttccatgttatcttacttttttccattgtagcccttagcatattcatcatggtgatttcaattcctagtctggtaattctaaaatgtctgccacaattgagtgtggttctgacatttgttttgtctcttcagacagtgttttttccttttagcatgacttctaactttttcatggaatctgaacatgacgtaccaaaaagctgaggtaaatatacatttagtgtgaagttttaggttcatctggctagaaattaggctgtcttcactgtttgctatagttgtgtcagaggctaaaatttcctctagtgtccttatttttgcctcccctgttgtctttagcttttcctagaattttttctttaaataagatttgaaacttgcaggtttttttttttttcagctgcaataccctgttttatggaaccctattggtgtggtggtaaattgtgaaggaaggaaaattctatagtcctatgattaagtctcagtcttttagtgaacctgtgtccctaggctgtgagcttcacaagtgctatttcactccctaccccttaagtgagacaggaaggctaaaggggacaggagtcgggtatttcccttctaccaggttggttagaattgtaaaatgatgcagccactgtggaaaacagtatgacattttctcaaaaaatttaaacatagaattactatatgatccagcaattctacttctgagtatatacccaaaggaattgaaagcagggactcaaacagatttgtatgccaatgtttacagcagtattatttataagagccaaaaggtggaaaaagtctaaatgttcattggcagatgaatggataaacaaaatgtgatgtatatataaatggaatattattcaacctttaaaatgaatgaaattctgatacatgctacaacatagatgcattttgaaaactgtatactaaatgagagaaaccagacacaaaatgctacatattatgtaatttcatttatatgaaatatccagaatggataaatccatagtcacagaaagattagtagttgccatggggaagaaggggatggggagtgaacattaatggtttcagggtttctttcgcagtgatgaaagtatttcagaattagataatagttctagtggtgacacaactttgtgaaaatactataaacacagaactgaacatttcaaaatgaccaaatttatactatatgaattatgccccaataaaaatatatgtctcaaaaagatagtaaatatagatagatagacagatagatagatagagctatttactatagaaagtgttaaaaacataccatcttttcatatactaattttggttttattaacaaacaaaattacataccattttattacgtgcctttttcaacttaatataaattgaaactattccacatcagtaaacctttctatgaaaatttttaaaaagaactgctgaaacatacaacgacacagatgcatctcaaaaacgtaatgtttaagaagagagccagtcacagtggctcacatctctaatcccagctactaggaaggctgagatggaagggtcaattgaacccaggagtttgagaccagcctgggaaatatagtgagatccctatctgaaacaaaaaaaagaagtaaattaaaacctataacatctaacaaaagaagctacacttaaaaacctacacacgtattattccttttatatgaaggacaggcaaaactaatttgtgataatagagattcaaccactaattaactgtaaaggaggtattgactgagttggggtatgaaagagccttctggggtcttagaaatgttctatatcttcatctgaatggtggttacaaaaatatgcatatatgtataaaatccatttaactgtacatgatatgtgtacacataactgtatataagttatcgttaattaaatttaaaaacgatgtggtattggtgcaaggatagactaatgtaacagaataaacagtccagaaacaaagagataaaaagagagacatgtttatatatgattacctaaatggcaacaaagtctttactgcagttcagtggggtaaagtatggtcttttcaataaatggtgataaaatgaaaatatgaaccctggctatacaaaaacatggactttgattcctaacccacaccatacacaaacaaattaacttgagatggaacatagacttaaacgtgaaaggcaaaactataaggtttctaaaataaaaattaggagaatacattaattatattagaataatcagaaatttcttaaacacaaagcacagtcagaaaaactgataaattgaactttataatattaaagatttttgttcatcaaaagatacaattaagagagcaaaaaggcaaaccaccaactgagagaagatattcatgaaattggcatatatacacatgcatatcctgttacaagtctataagaaaaagacagaaacttccattttaaaatagtcaaaatatttgttcagggccttcaataaagaaaatatttaaatggtcaataatcatgtaaaaagacgattaacatcattgctcattagagaaatgcaaactgaaaccacaatgaaatagcactagaaacccactagaatagctcacattaaaaagggctgaaaatatcaaatgttggcaagaatgcagagcacctcaaattctcataccttgctagtgagactataaagtagttcaacaatgatatggtttggctgtgtcaccacccaaatctcatcttgaattacagctctcataatccccaggtgtcttgggaggtacccggtgggaggtaattgaatcatgagggcggttttttcctgtgctgttctctgatattaaataagtctcacaagatctgatggttttataaagggcagttcccctgcacatactctcttgcctgctgccatgtaagacgtgcctttgctcctccttcaccttccaccatggttgtgaggcctccccagccatgtggaactgagagtccattaaacctctttttctgtataaattacccagcctcaggtatttcttcatagcagtatgaaaatggacgaatacaaacaactttggaaaaatatttagcagtgtctactaaaactaagtacatatatactcacgactcggcaattccaagcttaggtatatttccaagagcaataagtccatatgtgcatcaaaaggcatgtacaagaatgttcataacaggtttcttaaaagccccaaactggaaaacagcccaaatgttcagccacagtagaatagctcaaaagtggtggtatagtcatacaaagaagttctacataacaataaaagaaaatgaattccttatacctaaagtaacatggataaatctcacaaacaaaatgatgaagaaaacaacacaaacacaaaagaatgcattctgtatgcttcaatttaaataaaattcagtaaaccagcaaaattactctggcataaaagagctttctggggtgctggaaatgttttacattttgatatgtgtggtggttacatgggtgtacacatatgttaaaatttgttgagctctctactgaagtagagcttgacactgaagtagtgttcttcgctgtatgtaaaattatacctcagtgcaaagttaaattaaaagacatgtacaaaaatgattatagaagcatttttatcatagtttcaaattggaaacaacccaaatatccattagtagtagaataaataaattgtaatatattcatattgtagaatgctttatgaaaatgaaaaataaccaaccacttacatacacagaaacatagatgaatctcaaagacataatattgagcaaaagaagctagactacatgacccagcaattccactcctaggtatatattcaaaaaggtgaaaagcagggacgcaagcagaaacttgtacatcaatcttcatagcagcaatattcacaacagccaaaaatggaaaccaccaaaatgtccatcaatgcatgaacgggtaaacaaaatttggtatatctctagaatgggatgttattcagtcattaaaaaataatgtatggatacctgctatgatatgggtgaaccttgaacacattatgctaagtgaaagaagcgagacacaaaaggaccaacattgtatgattccactcatatgaggtggctagaataggtgaattcatagagacagaaaatagaatggtggttaccagaggttaaggggaagggaagttattatttaatcagtacagagtttcagtttgagataatgaagtagttctggaaatgaacagtggtaacggttgcccaacaatgtgaatatatttaataccactgaattgtacattcaaaaagtttacaatggtaaattttatgttatgtatattttatcacaatttttttaaaaagaagctggacacaaaagaatacataccgtatgcttccatttgattagaaaggggcaacagggaacttcctggagggctacctatatcttggccagggtggtagttacatggatgtatacatatgttaggaaaaaaaaaaaaaaagtcaggctgtcactttacagtatataaattatatttccatttaaaaagaaacgaggagaaactcggaaaaactgtcatttaaaagttgcttgcattttttaaatcctttgattatggagatttaggctcacctggaggcagattctctctttgaggaagtcagcaaagttggccctttcattctcactgctgtaaagccagaagctctgcattttttccagggggaaccttaaacctggagcagagattcagcttcttgccttggtcactcaaagtgggcggggtaaatcagagatgcgtttaggaagcttaatgccttttgagagtgaaggggaacaggataagggagagaggggcagaataaaaaatgtttctgggctgtgaaggaactgagaaggaattgggctggaagtgctgcttgttcctgtccaggtgattatgggcgcggaggcggaggcggggcgcagtggcgcaggcaagtttgatgagtgcagctgcaggagataagcagagatggccgaagtgactgctttcaagagacttggtatggctttcaggagacttggtatgactttcaggagacttggtgtgagcggtgttgcttcaggcaccgggggaaaattgcgggacaaagttgtaataatggcagataattttcgtcacctctcttatcttctttcaaaaccttgcaccccgtaaacccctgcggagtggcagtttggagcattgggacacagtacccttggtttggacacttgcagtctcacgcaaagcaacttcttgggtgtgagtggagagtaagaacatggaaaagatggataggggagctgaccgtaaccagtttgtaagtacatgaataaacatcccttttagttatgttttctgcacagaaatttggcacaggggtgcaggcagccctcaggcaggcagcccttgatggctcaaaacactttaactcgggcattaaaaattaagatgacctcagtctatctatactcacagcctgggaaagcctggatagaacagctgcatatgcgtaactgtttgtctatatgtgcatgtattaagtatgcatatttttgtaaaattatgtcctactgtatattgctttgaattcagtttgatttttgctgagcagtgtatttttagcatttccttattgtcagagattcttttaaaactgtgttcctaagatcaggagctttgcccagtggctggggtcttgctacccacctccgagctggagagcaaaccaccggccctcctgcctctcactcctgtgcctcccccattccctcatgagctctatttcttcgttccagaaggctttgggtcacgacattttggggcctggcttcactcctttcaggggagtaaagaggggtctcttttcagagccatatctggtacagttcagaaatccaagagcaggcaggtcaggtcatccaacgttgctgcactagtgtgaagaacgtagcaatcccagcatgctcccctctccccaccacctctccacagtttgctaagtaaagggactgaggtgagacgggtcaagggacttgccctggcatacagcaagctggtagcagggatggaacttgcacccaagtcttctgattcccccaaggtcaatgttttgccacccctcaccctgtacaccctccccataagtaactccagtggagaaatgaaattatccacaaaccacaaactaaagccacaaaaacacttctatttaattgctaccacaaatacagaatagaattaaggcagtataatacatttccacttatcctcacaagctttcatacagtaaactttgcttaaagtgtctatttgaatcagcaattgaaatttttattaaacagcagttttcttgaattgtagagaaaaatcatttcctggtctgtcaagtgtgctaataaaagacatctacgacttaacatcgtgtatcactgaaccttagccaagtgtggtgggattggctgatgtcggatgtgtggtaggattgattggtgtaggcatctctttcttctccttgcccccctccccatccgggaggaatgctcatttacaacctcccagcagtattcaattcgcttcttgctgccatttatttcttcaaattcccttttgaatgaaagcaataatgcaaaaactgtaaaaacaccaggctgtttaaaaaacaaaatcttcagtaaagagtagttatgacttataatattaaaaatattaccataattgatcctagcaaccgtaagattggattttaggagaagaaactagtttatgaatggatttatttctctggaactaaatgaaaaaaaatcccggcaaatgctaaaaaaggtaaataattacaaataaggtaaaaacgtcttatcatttgcaaccatgtttgactataaaaagcaccaatgttcaaattttcaaaaaatagaaataatttggtgtgcccatatctttccttttgccatttgatctcataggcataaaaaatgtatttttaataagagcttatcaaattgtattcttcaaatatgggtcatatgttgttgctgaaatttaggaaagaaactttccagtacttgtacttgatcacaactgcttttctgactgctattaaaagtacaatatagagttacacattgaagaacataaagctgtgcagtcacattaacggaagcgttcaccacaacacacctttagcattgcgcacatacccctctcccaaccccctcggggaatgggagaagaaagcaggaacaaggcagaggaaatgaggaaaggggaggagggacagaggagtgggaaaaaaatcaaagtctaaaatttcaaggatcactgaggactgaaggtcgaccatagttggaaagggaggtttggaacaacagatgtcaaacttgagggaaattaaggtctctaaaatagcaagcacacacacacccacgcacacactttaatacagtacattaagtaaaggatgagtacgcctgaaaggtggatgtagcttacaccatctctatgtgtcagtgtctgtgtctagatgcagtaaggcatctcactttggattacatatgcaaaacaaactagaaaggggaccactgcctggccacctacgagagcatttttcacacagccatttcatcaggatcatcttcaacatcaataaccacgacatcatggtaatcattggtactggtagtgactacagtagggtcaggaaggtcagcgatggtgtcagactccagctggctggcagcaggcttggtgggcccagcggcagggctagaggccgactcagggaggtcactgtcgtcagacacagggtgggcaatggcagggatctcggggcaatgggaggcagagagctcagggttgtcagcagcagtgggcttagggtggctggtagtggcaggcttgggatagtcagcagtggtgggctcagcatggctggtagctggcttgatgtggccagtggtgggtttagggtggctggtggcagcactgaaggcagacttggagtggctgccagcagagacatggtggccagtgatgggcttggggttgctggaagcaggcttgaaatgaacagagtcaggcttgaaatggacagagtcacccttgaaatggacagagtcagccttgaaatggacagaggcaggcttagggtagacagtggcagacttggggtgaccagaggcaggcttggagtggccagagacaggcttgaggtgaccagaggcagccttggagtggctaaagacagacttgtggtgggtagaggcagatttgcgataggcagaggaggatctggaatggggcttagggtggccagaggcacggtcggggtggccagctgcagcatcaccaggtaatggaacattccggacattcatcggggtttcctccacagcaggacaggcatgggcacggtcttgttcacgagcttggtcgcgagcatgggcacgggcgcgggccagggtacgggcctcctgcatctcacgaatatcactgatgaggccagagaagaatatgatagggtgccgcatagcatggaagatggtccagtattctcttcggaaattctcattgaggagcccgtagatcacagcgttgaggcagctgttgaagtaggctatgaagtaggctgcaagataaagccagttggggatcttgcctgccatctccttcggactgacagccaccaagacagtgagcacgttgatagggcaccagcacactgcaaagaggaggaagatcacaaacatggttagaaaattgcgaacctcagcaagttggttgtcaggattctgccctgcagggtcacgggccgccagcactttggtccagatcctcacgtagcagaaacccacgatgaggagagggaggacgaagtggatgcagacgatggtaacagtgaagacagggttgttcagatagttgaagatgcaggtgtaggtgcgaggatcgtactcgatggtgccaatgtacatgttgggcaggacagccaggacggtcatgatccaggtgatgaccaggtagatgcaggtattgcgcacactgaagatccgttcgtactggaggctgtggcagatgtagcagtaacggttgatagcgattgccacgatgttgaagatggagccgaccacactcagccctgtgatgaacccgaccatctggcactgtaactggctcagatcccagcccccaatggacatggcatgcagcatcaaagggtatgggtagatggccaccagcatatcggccacagagagactgaccacgaagatgttgcctgaaaaacatatcgagggagggagaaaggggaaagacagagaagaataagtggtttaagtacagaaatctacacatttaaggtgcaggggaaggccagctggattatgaccttttataattccagaattcttttaaagaaatgctctgagaaagaagcgaacataagacagacagcagtgagcacaaaatccctgccaggagccttcacaatgagacagggtcatgctgccaccatcttagagaaaaacaaaatgcaaacgtttccttcactggaggtgagggggagggagaaggaggaggggagtagaggtgagctagagggacttgtttttaggaaggaggctggagagtggggggcaaggagagacactggagggatgtcaggaagcctcaaactaaaaaaattaaaaataattaaataattagaaaaagataaattagccatctccctcctatagcctagcattgcatttataataaacacattactagagagaagattctgagaaaaggcattagaggccatcttcttaaacagtcttttccgatgggatcaagcagtaacctaaaaccttgccaagtcaaatacttaccgttccgaggtaacctaagagtgaaaactgaggggaagcagggaagccctgtaaaatttagtctgagaccaaagaagtagtgagagggcgggcgggaagggtggcgcgaggtgggcgggggtgggggggaggagaaaaaatcctgcaaggattagcagaagtgcctgtttcagttacatgccgcgtccacgtccacgcgcagagccgcgcactggcacattcagcgccctgcacagagctcccagcgccgggcactgaactttactggagccttcaggttaaacaggatagagaagaagggtcacccccactccggtcttgtagggctgaggtgggaacttttttgtaaaacctttcacaaaaaagagaaggaagaggccaggtgcaggcgcagagccctctttctttggagacacctcgttgctaattagcattggtttggcaaaatattgcacttcatcttggactaggagaaaatgagcgcttttgaaaagggcaaaggtatggctccttcttcctccttcctccagcgctgtcagcactcggcctcagcactttctaccgaagaggttctttctatggttttccggcagagtaatgaattcagggaaatacagccgaaaagagaaggggcaaagccttaaaaacaaaaccacaacaaccataaaagcctttatttgaattatagaaggaaggaaggagaaggagaaaaagaaagaaaagaaatctaaagggaataaaatgggcttcgcaggtcgcccccaggattccgtgggtttgcacctcgggaccgcaccgcgggggtgaaggtgaagacctagtgtatggccccacgattccaggagacgaaggagaaatcggagacacccaccagactttgtaagaaaacttttaatgactgtgtgccagtcagtgcgtttttaaacttgttcagtgttcgtgactccttgcccaagcaaagtaatcccccagaccccggccgccacctctcccccacgccctgcccgggagaatccagctggtctccccaccctctcagacccccttcggtccccactcctagccccagccgatcgagaatctggcggtggaaattccaggcgccgcccctccctcccccggcctgaactcggagtttgggcgcctttgccccttcccctcccttccagagccctctcccgcccaacctgtaagccggactagctgctctgcagtgtctgccgcccccacccccagcacaggtcgcagcgcccggcatcctcccacgcttccctcctgccctgctcgccgccggcccccggcccccggcctcctcccgctcggcagtggctagcagcgggggaagtcccgcctgcggctcccagaccccagccctttgcagcctctctgagtcccccatcgccgcctctgagctctcccgtcgccctcccgccaatccctactcggttttgctgccttctatccctccacccccagcaacgcccagctcccaagcctcttggccggcccgccctgcgaccccccagttccccgcttacggaccttgggatctccgctgccgccgccgtcgctgccaccgcctgctgtgcccgacccgccgcttgcctctctctgccgttcgccctgggacgggcggacggagctcggctccggcgggctcagacctccctgctcgattctcgggcgcgggggtctgtgctccgccgcccgggatctgcccgggagccgtcctggagccccagggccgcggcgagcgggctcttggcccggctagggagaggccactgcgttgcgctctggtaagggccgccgcggccgccgcgaacttaactttcacagagcaggtcgcagccccgctgctccctccgcgtcagttcggtccgcgctgcctcagcgcggccgcccttgcggcgtccggctcggcttgctgtccccgggcgaatcgcctgactctcccgctcgggtgccggctccctccgcatcaggccccgacgggacagggatcctcgggctgccgcgcaccacgggaacgctttgtacttggatgcccaaagctaattctctgtgctctctcggccttgagaacctccacgtttagagggccgggacagaatactaccacccccaggcttgcggggaatttgggagcagggatgttcaatatgagggcactgtccatagattctctattcggggagctcaaaaactaacgccctaggggttgcaagtctctgcacactgggtagggagaagaaggggtggcttaccagaattccggagcttcttgttcttcgtcacagccaaaatgaccatggagttgccgattaggtctacaacgatggtgataaccatcgcgcagaacataaagatgattagagccggtgggtattctggctggggtagcttacagccaatacagccatagggggtgggaaccgctagggtgggccccatgttgctcctggggatcgttaagatctcccagcaggctcaggatcagcagccaggtccagacagcaaacacctgttctgtcaccaggagctccaggaaagcgtgcctccctctctgagagtcagagagcaaatgacagcatcccgcccctctccgatgagcttttaaagcctcaagaggcggctagccccaccccaaatccctccccccgaccaatcagacctccctgaataccccccccttggctaccccctcttattggacaaatccacattgaggtgtcatcttgcttccgactgccttgtatgtacttcctctctagccagcctgccctgcctctcaatctcccaggtaccttgcaagcatcatgactagctcggagtccaccccacaccccctccaccagcccctgtgcattcgtttctagcaagttcttctccctctctcctccagtgcaaacacctggcaaagagatgtagattgcagagccggagcacagagtctttcataggatccagtgctagaccaagccagtccacagcccccagcagggtataggggatagccggtggccccttgaacgctagatgcttgcctctgcaagtatccttgtgaggtccatcccacgccccatgcccttgcctgtctagagccttctgtgtcccgcggggaacaggggactactgctgggagctcccacccccaatctgggtccctaatccctagggaacttaaccccgctccctttctcgccaggagcctcttggctcccttagcggcagctgcgagtagccgctcagtccggtccaggtcttgcactctccataaagagatgtaccctgcgcccgactctggaagtggggagcgggtctgcaccctgggacctagggaaggcattggtggccactcggtcctcagtttgggggcgaacgggagcgggagctcgtctcctttccagctgccggcagccaggcggcggaagccaagggacgctttgggaaaaagtaaaacaggcaataaagctcttctcttgggtccccgcttctcaaggaaactcaggacgagaggctctgacgcctctccctctcgggatgctcggcattctctactgagcggcacggggcagtcaggaaggctgaaggagctgcgccgcagccgcgggaaaggtgcggaggtgtcacgcggctaaaccaagaagcctctggctgaccggcgatccctgcctcagtcaggattcctctcggtctttctcctttcccatgcccttctggggttctcgtttcgaccccatccctctcaggcctcccccctcgccctccacaccgcggatctctgtccccgtgcgtcacagttcccctgcggtgcgcccaggatctcgctccgcggggaccacggaaaattcgaatattcgggcaaaactaaaggggcgtgattcggacactcgttccctcaataaccttggtcacgggaatggatttctgccggctactaaaagttacggctcctgtcgagaagcctttcaaaatctcagtaaacaccttgaaacttgttccagactagtcttcttgccacagtaggggagaggggttgcactggccgggagcgccatcgtctggacacagcagccctcttgccccggggtgggtggggggacggacaaggcggggtaggtagtaggggcctgttacgcgacgaacttcaacattcagatacctttaacgaaaaaaacagacactgttgaaaaccaagattgcacacactgtctctagctataaagcctaaactggaaatgtgtctccttgtttgaaaatgaagcccccaccccaatcctgcggctttcgcgtctgtgaactgaatccggcgcgaattacaatctcccgcctggaggcttttcacattcattatctcactgcccctcgctggctggaactcccggccgcgcgcgctcgcatttttttccgtaagtgcagacagtgaaggggctccgctgtcctccccacacagctgtgcgccctgtaaagaggctgtcagtcaaaagcccgtccgcgcagtggagtattttgtaggatgcacatcaggctgttcttgctggttccccgagagtttggatcccttcacttgtgggaaggggcgattttgaattcaaataagtaaacaaaatacatttgaaggaaaaaacgaaacacaccttctagtgacttaagacactagactccccctgccccaaacaaacctgtaaggagagcttgcaaaccttgcaggcattgctacactccagtgtactgcacttctgagatgaggtggctagagcccccgggaattccccgcggatgtggcctgaacatccctgggattgaggagcaggcaggagagcaagggtgagctgactccctggcccctacccctgcttggacactacttgactgtgacctggtgggacttggtttttcaatactagacaagtggaaaaggtgaatattttaatgatctagggggacagaattatgtatccggttaaaataattttcttatttttatgaactcgtcttaataaagattctgaacatggccccagtactaagaaaatcagatattgacaaaaaaattagccgggcgtggtggcgggcgcctgtagtcccagctactagggaggctgaagcaggagaatggcgtgaacccgggaggtggagcttatagtgagccgagatcccgccactgcactccagcctgggcgacaaagcaagaccccgtctcaaaaaaaaaaagaaaaaagaaaatcagatattgaatcagttataaggatacatatgagggagaaaatcggtccctgtttgcaaaggcaaaacaagtctcgtgcagtaagttcaattgctttggaagagttaagggggagtcctttattggatagagtgtaatgtgcatggtttaagattccactggatttttaattaagtctctttctaaaaggcttgttaggaagccctaaataactggagtggacataaaccctttatttgagattttaaagctattaagatatccaatccaaatagaggaaacctggaatattcccagaggaatgagagggcaagtgagcagtttctgctcaggaatgggtaatccttctgagcacatgagggtactgcctgcatcttcagttccctgatttacatcggcaatgatggaaggttaccttttatcaaacgttctaagctctctgtttaaccctccagcactataataatgccttgcttgtaactagtgagtacagttttaaataagcatattatagttttcaaaagttcattgggaaaatgttttctcacaatgtcattaaatagataagaaaactgaggccccagagaggtgaaagaacttgtccaaggtcatgccaaggcttaaatccaggctggattccctctcagctcaag
